US011713468B2

(12) United States Patent
Minshull et al.

(10) Patent No.: US 11,713,468 B2
(45) Date of Patent: Aug. 1, 2023

(54) DNA VECTORS AND ELEMENTS FOR SUSTAINED GENE EXPRESSION IN EUKARYOTIC CELLS

(71) Applicant: DNA TWOPOINTO INC., Newark, CA (US)

(72) Inventors: Jeremy Minshull, Los Altos, CA (US); Maggie Lee, San Jose, CA (US)

(73) Assignee: DNA TWOPOINTO INC., Newark, CA (US)

( * ) Notice: Subject to any disclaimer, the term of this patent is extended or adjusted under 35 U.S.C. 154(b) by 563 days.

(21) Appl. No.: 16/635,886

(22) PCT Filed: Aug. 2, 2018

(86) PCT No.: PCT/US2018/045041
§ 371 (c)(1),
(2) Date: Jan. 31, 2020

(87) PCT Pub. No.: WO2019/028273
PCT Pub. Date: Feb. 7, 2019

(65) Prior Publication Data
US 2020/0283798 A1    Sep. 10, 2020

Related U.S. Application Data

(60) Provisional application No. 62/608,114, filed on Dec. 20, 2017, provisional application No. 62/571,050, filed on Oct. 11, 2017, provisional application No. 62/540,315, filed on Aug. 2, 2017.

(51) Int. Cl.
*C07H 21/04*    (2006.01)
*C12N 15/00*    (2006.01)
*C12N 15/63*    (2006.01)
*C12N 15/86*    (2006.01)
*A01K 67/00*    (2006.01)

(52) U.S. Cl.
CPC .... *C12N 15/86* (2013.01); *C12N 2750/14143* (2013.01); *C12N 2820/60* (2013.01); *C12N 2830/15* (2013.01); *C12N 2830/48* (2013.01); *C12N 2830/50* (2013.01)

(58) Field of Classification Search
CPC .......... C12N 15/86; C12N 2750/14143; C12N 2820/60; C12N 2830/15; C12N 2830/48; C12N 2830/50
See application file for complete search history.

(56) References Cited

U.S. PATENT DOCUMENTS

| 8,227,432 | B2 * | 7/2012 | Hackett | C12N 9/22 |
| | | | | 536/23.1 |
| 9,487,787 | B2 * | 11/2016 | Wandless | C12N 15/62 |
| 9,567,577 | B2 | 2/2017 | Jang et al. | |
| 2013/0183664 | A1 | 7/2013 | Welch et al. | |
| 2013/0273006 | A1 | 10/2013 | Alonso et al. | |
| 2015/0291976 | A1 † | 10/2015 | Minshull | |
| 2016/0177335 | A1 | 6/2016 | Clarke | |
| 2016/0340691 | A1 † | 11/2016 | Minshull | |
| 2017/0101629 | A1 † | 4/2017 | Minshull | |
| 2017/0114363 | A1 | 4/2017 | Goel et al. | |
| 2019/0352631 | A1 * | 11/2019 | Lin | C12N 15/90 |

FOREIGN PATENT DOCUMENTS

EP    1939779 A2    7/2008

OTHER PUBLICATIONS

GenBank Accession No. JI893465. Cricetulus griseus contig03602 mRNA sequence, 2 pages; (Year: 2011).*
WIPO Application No. PCT/US2018/045041, PCT International Search Report and Written Opinion of the International Searching Authority dated Jan. 3, 2019.
WIPO Application No. PCT/US2018/045041, PCT International Preliminary Report on Patentability dated Feb. 4, 2020.
Author names: Maria João Ferreira, Diogo Vale, Luis Cunha, and Paula Meio, Title: Role of the C-terminal extension peptide of plastid located glutamine synthetase from Medicago truncatula: Crucial for enzyme activity and needless for protein import into the plastids, pages being submitted: 226-233, publication date: Nov. 25, 2016, Journal: Plant Physiology and Biochemistry, vol. 111, and place of publication—website link: https://www.sciencedirect.com/science/article/abs/pii/S0981942816304466 accessed on Oct. 10, 2022.†
Author names: Lorena Saelices, Rocio Robles-Rengel, Francisco J. Florencio and M. Isabel Muro-Pastor, Title: A core of three amino acids at the carboxyl-terminal region of glutamine synthetase defines its regulation in cyanbacteria, pages being submitted: 486-496, publication date: Feb. 26, 2015, Journal: Molecular Microbiology, vol. 96, No. 3, and place of publication—website link: https://onlinelibrary.wiley.com/doi/pdf/10.1111/mmi.12950 accessed on Oct. 10, 2022.†

* cited by examiner
† cited by third party

*Primary Examiner* — Quang Nguyen
(74) *Attorney, Agent, or Firm* — Alston & Bird LLP

(57) ABSTRACT

The present invention provides polynucleotide vectors for high expression of heterologous genes. Some vectors further comprise novel elements that further improve expression. The gene transfer systems can be used in methods, for example, gene expression, bioprocessing, gene therapy, insertional mutagenesis, or gene discovery.

18 Claims, No Drawings

Specification includes a Sequence Listing.

DNA VECTORS AND ELEMENTS FOR SUSTAINED GENE EXPRESSION IN EUKARYOTIC CELLS

CROSS REFERENCE TO RELATED APPLICATIONS

The present application is a US national stage entry of PCT/US2018/045041 filed Aug. 2, 2018, which claims the benefit of 62/540,315, filed Aug. 2, 2017, 62/571,050, filed Oct. 11, 2017 and 62/608,114 filed Dec. 20, 2017, incorporated by reference in their entirety for all purposes.

REFERENCE TO A SEQUENCE LISTING

The application refers to sequences disclosed in a txt file named 542905SEQLST.txt, of 1,086,748 bytes, created Jan. 31, 2020, incorporated by reference.

1. FIELD OF THE INVENTION

The field of this invention relates to the design and construction of plasmids for prolonged and stable expression in eukaryotic cells. Specifically, we disclose advantageous combinations of sequence elements for function in piggyBac-related transposons and adeno-associated viral (AAV) vectors. Computer systems and methods for designing sets of nucleic acid construct variants and tools for relating the functional properties of such nucleic acid constructs to their sequences are also aspects of the invention. The use of these relationships to determine the relationship between a nucleic acid construct's sequence and commercially relevant properties of that nucleic acid construct are also aspects of the invention. Such sequence-activity relationships may be used to design and synthesize commercially useful nucleic acid construct compositions. Specific combinations of elements are also aspects of the invention.

2. BACKGROUND OF THE INVENTION

DNA constructs are typically propagated as plasmids. Plasmids are frequently constructed by cloning a first polynucleotide sequence into a vector. The vector generally comprises sequences required for propagation in at least one host cell, but it often also comprises sequences that contribute to the functioning of the first polynucleotide sequence. For example a vector may comprise elements that affect the expression of a polypeptide encoded by the first polynucleotide sequence such as promoters, enhancers, introns, terminators, translational initiation signals, poly adenylation signals, replication elements, RNA processing and export elements, and elements that affect chromatin structure. The process of optimizing a polynucleotide for a specific function often comprises creating a plurality of polynucleotides, cloning them into the same vector to create a first plurality of cloned polynucleotides and measuring a property of some of the cloned polynucleotides.

Adenovirus Associated Virus vectors comprise a pair of terminal repeats (ITRs) flanking a heterologous polynucleotide. The AAV ITRs allow the heterologous polynucleotide to be packaged into viral particles. AAV ITRs also play a role in the stable maintenance of the DNA within a target cell. Thus, the heterologous polynucleotide sequences within an AAV vector will be preceded by a first (5') ITR (e.g. a sequence selected from one of SEQ ID NO: 1-6) and will be followed by a second (3') ITR (e.g. a sequence selected from one of SEQ ID NO: 1-6). The ITRs may be exact or inexact repeats and are inverted in orientation with respect to each other.

Transposon vectors comprise a heterologous polynucleotide flanked by two ends that are recognized by a transposase. Transposon ends also comprise ITRs at their ends These ITRs may be exact or inexact repeats and are inverted in orientation with respect to each other. Thus, the heterologous polynucleotide sequences within a transposon vector will be preceded by a first (5') ITR (e.g. a sequence selected from one of SEQ ID NO: 7-10) and will be followed by a second (3') ITR (e.g. a sequence selected from one of SEQ ID NO: 7-10). The transposase acts on the transposon to remove it from one DNA molecule and integrate it into another. The heterologous DNA between the two transposon ends is transposed by the transposase along with the transposon ends. Heterologous DNA flanked by a pair of transposon ends, such that it is recognized and transposed by a transposase is referred to herein as a synthetic transposon. Introduction of a synthetic transposon and a corresponding transposase into the nucleus of a eukaryotic cell may result in transposition of the transposon into the genome of the cell.

The ITRs of both of these classes of vectors help to ensure stable propagation of the heterologous polynucleotide that they flank within a target eukaryotic cell. However, the regulatory elements that comprise the heterologous polynucleotide profoundly affect expression from these stably propagated vectors. Methods of identifying beneficial combinations of elements, and advantageous regulatory sequences for transposons and AAV vectors are aspects of the invention.

3. SUMMARY OF THE INVENTION

The process of cloning polynucleotides into a single vector is relatively simple, while the process of constructing a vector is more complex and costly. Expression optimization efforts are therefore more commonly directed toward creating variation in the cloned polynucleotide and rarely on variations in the vector. Even if the vector sequence is varied, this will typically be done by selecting from a small number of pre-existing vectors rather than by deliberately constructing a new set of vectors. However, vectors frequently contain many or even most of the elements that determine the function of the cloned polynucleotide, for example the expression of the polynucleotide in an expression-host. The functional performance of many of these elements may depend on the precise host cell being used, for example some elements that perform well in human cells may perform poorly in rodent cells, the same vector is often used in both.

Furthermore, many available vectors have been constructed by standard restriction site cloning methods from other vectors wherein the functional elements were not well defined. Consequently, many vectors contain "fossil" sequences that are unnecessary for their function but have just been included because of imprecise cloning methods or a lack of understanding of function (for example the f1 phage origin of replication, originally incorporated for generation of phagemids and which can be found in many vectors that are never used to make phagemids). Vectors may also contain sequences that actually compromise function (for example the use of the beta lactamase gene as a selectable marker that exacerbates instability in vectors such as lentiviruses).

Because of the immense size of sequence space, there is no effective way to test all possible permutations of a polymeric biological molecule such as a nucleic acid or protein for a desired property. To test each possible nucleotide base at each position in a vector, rapidly leads to such a large number of molecules to be tested such that no available methods of synthesis or testing are feasible, even for a polymer of modest length. Furthermore, most molecules generated in such a way would lack any measurable level of the desired property. Total sequence space is very large and the functional solutions in this space are sparsely distributed.

There is thus a need in the art for methods to efficiently identify vector components that contribute to performance, and to assess this performance. This need is particularly great for AAV vectors, because the AAV viral particle will only package 4.7 kb of sequence. Each ITR is between 130 and 170 bp long, so there is a total of 4.3-4.4 kb of remaining space within the vector for regulatory elements and elements encoding expressed sequences.

The systems and methods described here apply computational biology and data mining techniques to important molecular design problems. In particular, we describe novel ways to assess the performance of individual vector elements by analyzing the function of small numbers of vectors. The results of this analysis can then be used to create high performing combinations of the sequence elements. Such maps are used to direct perturbations or modifications of the nucleic acid construct sequences in order to perturb or modify the activity of the nucleic acid construct in a controlled fashion.

Specific combinations of vector elements are described that contribute to AAV and transposon vector performance in mammalian cells, in particular to the expression of polypeptides. Vector elements include promoters, enhancers, introns, terminators, translational initiation signals, polyadenylation signals, replication elements, RNA processing and export elements, elements that affect chromatin structure and elements that enhance expression without a currently understood mechanism of action.

All polynucleotides described herein are useful for the transfer of genes to be expressed in eukaryotic cells, and more particularly for the transfer of genes for expression in mammalian cells. A method comprising the introduction of any polynucleotide described herein into a mammalian cell is an aspect of the invention. The polynucleotides described herein are intended to be maintained within a mammalian cell for long enough to express the genes that they encode. A mammalian cell comprising any of the polynucleotides described herein is an aspect of the invention: the polynucleotide may be maintained extra-chromosomally, or it may be integrated into the mammalian genome.

The invention provides a method for constructing an expression vector. The method comprises a. selecting a plurality of sequence element groups and, for each respective sequence element group in said plurality of sequence element groups, selecting one or more element sequences; wherein the possible combinations of the plurality of sequence element groups and the one or more element sequences for each respective sequence element group in the plurality of sequence element groups collectively define an expression vector sequence-space; b. constructing a first plurality of variants of expression vectors thereby forming a variant set, wherein said variant set comprises a subset of said polynucleotide vector sequence-space, each expression vector comprising an open reading frame or RNA-encoding sequence in operable linkage to one or more element sequences; c. measuring expression of the open reading frame from all or a portion of the variants in the variant set; d. modeling, using a suitably programmed computer, a sequence-activity relationship between (i) one or more element sequences in one or more element groups of the nucleic acid construct represented by the variant set and (ii) the expression of the open reading frame or RNA encoding sequence measured for all or the portion of the variants in the variant set, wherein the sequence-activity relationship has the form $Y=(w1x1+w2x2,+ \ldots wixi)$; wherein Y is a quantitative measure of gene expression; xi is a descriptor of a sequence element, a combination of sequence elements, or a component of one or more sequence elements, in one or more element groups; and wi is a weight of the descriptor; and wherein the modeling comprises:

i) optimizing, using a suitably programmed computer, the sequence-activity relationship by adjusting individual weights wi for each said descriptor xi using a refinement algorithm that minimizes the difference between the predicted values and the real values of Y from partial data, wherein the partial data is the first plurality of variants with individual sequences left out on a random basis, and ii) repeating the optimizing i) a plurality of times thereby obtaining, for each respective element or combination of elements or component of elements xi (a) an average value for the weight wi describing a relative or absolute contribution of the respective element or combination of elements or component of elements xi to Y, and (b) a standard deviation, variance or other measure of variability of the weight wi describing the relative or absolute contribution of the respective element or combination of elements or component of elements xi to Y; and e. constructing a new expression vector by selecting at least one element for which a descriptor xi has a weight wi whose mean value minus its standard deviation is greater than zero.

Optionally, the first variant set of vectors comprise at least 10 vectors, which collectively show variation in at least two sequence element groups. Optionally, each vector in the variant vector set further comprises a sequence selected from SEQ ID NOs: 1-6.

The invention further provides a polynucleotide comprising a sequence selected from SEQ ID NO: 323-432, a polynucleotide comprising a sequence selected from SEQ ID NO: 433-495, a vector comprising a DNA sequence selected from SEQ ID NOs: 317-322, or a polynucleotide comprising a sequence selected from SEQ ID NOs: 1-6 and at least 100 contiguous bases from a sequence selected from SEQ ID Nos: 496-499.

The invention further provides a method for expressing a an open reading frame or RNA-encoding sequence comprising introducing into a mammalian cell the polynucleotide comprising a sequence selected from SEQ ID NOs: 1-6, wherein the polynucleotide is in operable linkage with the open reading frame or RNA-encoding sequence and the open reading frame or RNA-encoding sequence is expressed. The invention further provides a mammalian cell comprising the polynucleotide comprising a sequence selected from SEQ ID NOs: 1-6.

The invention further provides a polynucleotide comprising a sequence selected from SEQ ID NOs 242-292. The invention further provides a polynucleotide comprising SEQ ID NO: 316 operably linked to a heterologous promoter. The invention further provides a polynucleotide comprising an alpha posttranscriptional regulatory element (PRE sub-element comprising a sequence selected from SEQ ID NOs 301-307, operably linked to a heterologous promoter. The invention further provides a polynucleotide comprising a beta PRE sub-element comprising a sequence selected from SEQ ID NOs 308-316 operably linked to a heterologous promoter. The invention further provides a polynucleotide comprising a gamma PRE sub-element comprising a sequence selected from SEQ ID NOs 297-300, operably linked to a heterologous promoter. The invention further provides a delta PRE sub-element comprising a sequence selected from SEQ ID NOs 293-296, operably linked to a heterologous promoter. The invention further provides a polynucleotide comprising an alpha, beta, gamma or delta PRE sub element derived from one natural source, and an alpha, beta, gamma or delta PRE sub element derived from a different natural source.

The invention further provides a polynucleotide comprising two open reading frames or RNA-encoding sequences, wherein each open reading frame or RNA-encoding sequence is operably linked to a different PRE element. Optionally one of the PRE elements comprises a sequence selected from SEQ ID NOs: 228-292. Optionally one of the PRE elements comprises a sequence selected from SEQ ID NOs: 305-307 or 312-316.

The invention further provides a method for expressing an open reading frame or RNA-encoding sequence comprising introducing into a mammalian cell the polynucleotide comprising a sequence selected from SEQ ID NOs 242-292 operably linked to the open reading frame or RNA-encoding sequence, wherein the open reading frame or RNA-encoding sequence is expressed, or a mammalian cell comprising the polynucleotide of claim 10.

The invention further provides a polynucleotide comprising SEQ ID NO: 25 operably linked to a heterologous promoter. Optionally, the heterologous promoter comprises a sequence selected from SEQ ID NO: 29-52 or 57-78.

The invention further provides a polynucleotide comprising SEQ ID NO: 25 operably linked to a heterologous intron, wherein the intron has at least 95% sequence identity to a sequence selected from SEQ ID Nos: 99-113 or 122-135.

The invention further provides a polynucleotide comprising SEQ ID NO: 76, operably linked to a heterologous open reading frame or RNA encoding sequence. Optionally, the polynucleotide further comprises a sequence selected from SEQ ID NOs: 71-74 operably linked to the open reading frame or RNA encoding sequence. Optionally, the polynucleotide further comprises an intron having at least 95% sequence identity to a sequence selected from SEQ ID NOs: 122-135.

The invention further provides a polynucleotide comprising an intron having at least 95% sequence identity to a sequence selected from SEQ ID NO: 99-105 operably linked to a heterologous open reading frame.

The invention further provides a polynucleotide comprising an enhancer sequence with at least 95% sequence identity to SEQ ID NO: 26 and a heterologous open reading frame or RNA-encoding sequence in operable linkage.

The invention further provides a polynucleotide comprising a promoter sequence with at least 95% sequence identity to SEQ ID NO: 58 and a heterologous open reading frame or RNA-encoding sequence in operable linkage.

The invention further provides a polynucleotide comprising a regulatory sequence with at least 95% sequence identity to SEQ ID NO: 142-191. Optionally, the polynucleotide further comprises a sequence selected from SEQ ID NO: 581-584.

The invention further provides a method for expressing an open reading frame or RNA-encoding sequence comprising introducing into a mammalian cell a polynucleotide comprising SEQ ID NO: 25 operably linked to a heterologous promoter operably linked to the open reading frame, wherein the open reading frame or RNA-encoding sequence is expressed; or a mammalian cell comprising the polynucleotide.

The invention further provides a polynucleotide encoding a glutamine synthetase comprising an amino acid sequence selected from SEQ ID NO: 505-506 or 513-518. The invention further provides a polynucleotide encoding a polypeptide comprising a glutamine synthetase and a peptide of SEQ ID NO: 502.

The invention further provides a polynucleotide encoding a glutamine synthetase comprising a sequence selected from SEQ ID NO: 509-512. Optionally, the polynucleotide further comprising a promoter operably linked to a heterologous open reading frame that does not encode the glutamine synthetase. Optionally, the polynucleotide further comprises a first promoter operably linked to a first heterologous open reading frame and a second promoter operably linked to a second open reading frame, wherein neither the first nor the second heterologous open reading frame encodes the glutamine synthetase. Optionally, the polynucleotide further comprises a sequence selected from SEQ ID NO: 7-10. Optionally, the polynucleotide further comprises a sequence selected from SEQ ID NO: 500-501 operably linked to the open reading frame encoding the glutamine synthetase. Optionally, the polynucleotide further comprises a promoter sequence selected from SEQ ID NO: 79-90 in operable linkage with the open reading frame encoding the glutamine synthetase. Optionally the polynucleotide further comprises SEQ ID NO: 141 operably linked to an open reading frame encoding the glutamine synthetase. Optionally, the polynucleotide further comprises a sequence selected from SEQ ID NO: 11-28 operably linked to an open reading frame encoding the glutamine synthetase. Optionally, the polynucleotide further comprises a sequence selected from SEQ ID NO: 29-78 in operable linkage with a second heterologous open reading frame. The glutamine synthetase can be encoded by a cDNA sequence or a sequence including at least one intron. Optionally, the polynucleotide further comprises an intron sequence at least 95% identical to a sequence selected from SEQ ID NO: 91-140.

The invention further provides a polynucleotide comprising a sequence selected from SEQ ID NO: 510-512 or 519-556.

The invention further provides a method for expressing a glutamine synthetase comprising introducing into a mammalian cell a polynucleotide encoding a glutamine synthetase comprising an amino acid sequence selected from SEQ ID NO: 505-506 or 513-518, wherein the glutamine synthetase is expressed; or a mammalian cell comprising the polynucleotide.

4. DETAILED DESCRIPTION OF THE INVENTION

4.1 Definitions

Use of the singular forms "a," "an," and "the" include plural references unless the context clearly dictates otherwise. Thus, for example, reference to "a polynucleotide" includes a plurality of polynucleotides, reference to "a substrate" includes a plurality of such substrates, reference to "a variant" includes a plurality of variants, and the like.

Terms such as "connected," "attached," "linked," and "conjugated" are used interchangeably herein and encompass direct as well as indirect connection, attachment, linkage or conjugation unless the context clearly dictates otherwise. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the invention. Where a value being discussed has inherent limits, for example where a component can be present at a concentration of from 0 to 100%, or where the pH of an aqueous solution can range from 1 to 14, those inherent limits are specifically disclosed. Where a value is explicitly recited, it is to be understood that values which are about the same quantity or amount as the recited value are also within the scope of the invention. Where a combination is disclosed, each sub combination of the elements of that combination is also specifically disclosed and is within the scope of the invention. Conversely, where different elements or groups of elements are individually disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Unless defined otherwise herein, all technical and scientific terms used herein have the same meaning as commonly understood by one of ordinary skill in the art to which this invention belongs. Singleton, et al., *Dictionary of Microbiology and Molecular Biology*, 2nd Ed., John Wiley and Sons, New York (1994), and Hale & Marham, *The Harper Collins Dictionary of Biology*, Harper Perennial, N Y, 1991, provide one of skill with a general dictionary of many of the terms used in this invention. Although any methods and materials similar or equivalent to those described herein can be used in the practice or testing of the present invention, the preferred methods and materials are described. Unless otherwise indicated, nucleic acids are written left to right in 5' to 3' orientation; amino acid sequences are written left to right in amino to carboxy orientation, respectively. The terms defined immediately below are more fully defined by reference to the specification as a whole.

The "configuration" of a polynucleotide means the functional sequence elements within the polynucleotide, and the order and direction of those elements.

The term "construct" or "nucleic acid construct" refers to the total nucleic acid component of a system. The properties of a biological system including natural as well as non-natural systems with respect to any function of interest depends on the interaction between multiple nucleic acid sequence elements, which may be located at positions throughout the total nucleic acid component of the system, here referred to as the "nucleic acid construct" of the system. A nucleic acid construct is a molecule formed by the covalent linkage of repeating units of similar structures. The sequence of a nucleic acid construct is a linear description of the composition of that nucleic acid construct. For example, for a polynucleotide it is a description of the order of covalent linkage of nucleotide bases. For the purposes of this invention, the term sequence may optionally also include a description of elements that are modified subsequent to their incorporation into the nucleic acid construct, for example modifications of tRNA bases such as methylation of uracil, modifications of protein amino acids such as glycosylation, modifications of polyketide elements such as methylation or glycosylation and so on.

The term "counter-selectable marker" means a polynucleotide sequence that confers a selective disadvantage on a host cell. Examples of counter-selectable markers include sacB, rpsL, tetAR, pheS, thyA, gata-1, ccdB, kid and barnase (Bernard, 1995, Journal/Gene, 162: 159-160; Bernard et al., 1994. Journal/Gene, 148: 71-74; Gabant et al., 1997, Journal/Biotechniques, 23: 938-941; Gababt et al., 1998, Journal/Gene, 207: 87-92; Gababt et al., 2000, Journal/Biotechniques, 28: 784-788; Galvao and de Lorenzo, 2005, Journal/Appl Environ Microbiol, 71: 883-892; Hartzog et al., 2005, Journal/Yeat, 22:789-798; Knipfer et al., 1997, Journal/Plasmid, 37: 129-140; Reyrat et al., 1998, Journal/Infect Immun, 66: 4011-4017; Soderholm et al., 2001, Journal/Biotechniques, 31: 306-310, 312; Tamura et al., 2005, Journal/Appl Environ Microbiol, 71: 587-590; Yazynin et al., 1999, Journal/FEBS Lett, 452: 351-354). Counter-selectable markers often confer their selective disadvantage in specific contexts. For example, they may confer sensitivity to compounds that can be added to the environment of the host cell, or they may kill a host with one genotype but not kill a host with a different genotype. Conditions which do not confer a selective disadvantage on a cell carrying a counter-selectable marker are described as "permissive". Conditions which do confer a selective disadvantage on a cell carrying a counter-selectable marker are described as "restrictive".

The term "coupling element" or "translational coupling element" means a DNA sequence that allows the expression of a first polypeptide to be linked to the expression of a second polypeptide. Internal ribosome entry site elements (IRES elements) and cis-acting hydrolase elements (CHYSEL elements) are examples of coupling elements.

The terms "DNA sequence", "RNA sequence" or "polynucleotide sequence" mean a contiguous nucleic acid sequence. The sequence can be an oligonucleotide of 2 to 20 nucleotides in length to a full length genomic sequence of thousands or hundreds of thousands of base pairs.

The term 'element' refers to a contiguous nucleic acid sequence that confers a function to the nucleic acid construct. Examples include promoters, enhancer elements, tags, solubilization signals, polyadenylation signals, replication elements, introns, terminator elements, RNA export elements and the like. The element can be an oligonucleotide of 6 to 20 nucleotides in length to a full length genomic sequence of thousands of base pairs.

The term "expression construct" means any polynucleotide designed to transcribe an RNA. For example, a construct that contains at least one promoter which is or may be operably linked to a downstream gene, coding region, or polynucleotide sequence (for example, a cDNA or genomic DNA fragment that encodes a polypeptide or protein, or an RNA effector molecule, for example, an antisense RNA, triplex-forming RNA, ribozyme, an artificially selected high affinity RNA ligand (aptamer), a double-stranded RNA, for example, an RNA molecule comprising a stem-loop or hairpin dsRNA, or a bi-finger or multi-finger dsRNA or a microRNA, or any RNA).

An "expression vector" is a polynucleotide comprising one or more regulatory sequence elements that can be operably linked to a second polynucleotide to create an expression construct in order to express a gene encoded on the second polynucleotide. The term expression vector is used herein to refer to the combination of regulatory sequence elements that control gene expression, other than the gene to be expressed.

The term "expression polypeptide" means a polypeptide encoded by a gene on an expression construct.

The term "expression system" means any in vivo or in vitro biological system that is used to produce one or more gene product encoded by a polynucleotide.

A "gene transfer system" comprises a vector or gene transfer vector, or a polynucleotide comprising the gene to be transferred which is cloned into a vector (a "gene transfer polynucleotide" or "gene transfer construct"). A gene transfer system may also comprise other features to facilitate the process of gene transfer. For example, a gene transfer system may comprise a vector and a lipid or viral packaging mix for enabling a first polynucleotide to enter a cell, or it may comprise a polynucleotide that includes a transposon and a second polynucleotide sequence encoding a corresponding transposase to enhance productive genomic integration of the transposon. The transposases and transposons of a gene transfer system may be on the same nucleic acid molecule or on different nucleic acid molecules. The transposase of a gene transfer system may be provided as a polynucleotide or as a polypeptide.

Two elements are "heterologous" to one another if not naturally associated. For example, a nucleic acid sequence encoding a protein linked to a heterologous promoter means a promoter other than that which naturally drives expression of the protein. A heterologous nucleic acid flanked by transposon ends or ITRs means a heterologous nucleic acid not naturally flanked by those transposon ends or ITRs, such as a nucleic acid encoding a polypeptide other than a transposase, including an antibody heavy or light chain. A nucleic acid is heterologous to a cell if not naturally found in the cell or if naturally found in the cell but in a different location (e.g., episomal or different genomic location) than the location described.

The term "host" means any prokaryotic or eukaryotic organism that can be a recipient of a nucleic acid. A "host," as the term is used herein, includes prokaryotic or eukaryotic organisms that can be genetically engineered. For examples of such hosts, see Maniatis et al., Molecular Cloning. A Laboratory Manual, Cold Spring Harbor Laboratory, Cold Spring Harbor, N.Y. (1982). As used herein, the terms "host," "host cell," "host system" and "expression host" can be used interchangeably.

An "IRES" or "internal ribosome entry site" means a specialized sequence that directly promotes ribosome binding, independent of a cap structure.

An 'isolated' polypeptide or polynucleotide means a polypeptide or polynucleotide that has been either removed from its natural environment, produced using recombinant techniques, or chemically or enzymatically synthesized. Polypeptides or polynucleotides of this invention may be purified, that is, essentially free from any other polypeptide or polynucleotide and associated cellular products or other impurities.

The terms "nucleoside" and "nucleotide" include those moieties which contain not only the known purine and pyrimidine bases, but also other heterocyclic bases which have been modified. Such modifications include methylated purines or pyrimidines, acylated purines or pyrimidines, or other heterocycles. Modified nucleosides or nucleotides can also include modifications on the sugar moiety, for example, where one or more of the hydroxyl groups are replaced with halogen, aliphatic groups, or is functionalized as ethers, amines, or the like. The term "nucleotidic unit" is intended to encompass nucleosides and nucleotides.

An "Open Reading Frame" or "ORF" means a portion of a polynucleotide that, when translated into amino acids, contains no stop codons. The genetic code reads DNA sequences in groups of three base pairs, which means that a double-stranded DNA molecule can read in any of six possible reading frames-three in the forward direction and three in the reverse. An ORF typically also includes an initiation codon at which translation may start. In prokaryotes, open reading frames lack introns. In eukaryotes, open reading frames may contain introns which are spliced out in the generation of mRNA, which is then translated into a protein.

An RNA-encoding sequence is a portion of a polynucleotide that is translated into an RNA, such as a tRNA, rRNA, micro RNA or RNA regulatory element, which is not translated into a polypeptide. Unless the context requires otherwise, any reference to expression of an open reading frame should be understood as disclosing in the alternative expression of an RNA-encoding sequence. For example, if the application discloses that a promoter can be operably linked to an open reading frame, the application should be understood as alternatively disclosing the promoter can be linked to an RNA-encoding sequence.

The term "operably linked" refers to functional linkage between two sequences such that one sequence modifies the behavior of the other. For example, a first polynucleotide comprising a nucleic acid expression control sequence (such as a promoter, IRES sequence, enhancer, intron or array of transcription factor binding sites) and a second polynucleotide are operably linked if the first polynucleotide affects transcription and/or translation of the second polynucleotide. Similarly, a first amino acid sequence comprising a secretion signal, or a subcellular localization signal and a second amino acid sequence are operably linked if the first amino acid sequence causes the second amino acid sequence to be secreted or localized to a subcellular location.

The term "overhang" or "DNA overhang" means the single-stranded portion at the end of a double-stranded DNA molecule. Complementary overhangs are those which will base-pair with each other.

A "piggyBac-like transposase" means a transposase with at least 20% sequence identity as identified using the TBLASTN algorithm to the piggyBac transposase from *Trichoplusia ni*, and as more fully described in Sakar, A. et. al., (2003). Mol. Gen. Genomics 270: 173-180. "Molecular evolutionary analysis of the widespread piggyBac transposon family and related 'domesticated' species", and further characterized by a DDE-like DDD motif, with aspartate residues at positions corresponding to D268, D346, and D447 of *Trichoplusia ni* piggyBac transposase on maximal alignment. PiggyBac-like transposases are also characterized by their ability to excise their transposons precisely with a high frequency. A "piggyBac-like transposon" means a transposon having transposon ends which are the same or at least 80% and preferably at least 90, 95, 96, 97, 98 or 99% identical to the transposon ends of a naturally occurring transposon that encodes a piggyBac-like transposase. A piggyBac-like transposon includes an inverted terminal repeat (ITR) sequence of approximately 12-16 bases at each end and is flanked on each side by a 4 base sequence corresponding to the integration target sequence which is duplicated on transposon integration (the Target Site Duplication or Target Sequence Duplication or TSD). PiggyBac-like transposons and transposases occur naturally in a wide range of organisms including *Argyrogramma agnate*

(GU477713), *Anopheles gambiae* (XP_312615; XP_320414; XP_310729), *Aphis gossypii* (GU329918), *Acyrthosiphon pisum* (XP_001948139), *Agrotis ypsilon* (GU477714), *Bombyx mori* (BAD11135), *Ciona intestinalis* (XP_002123602), *Chilo suppressalis* (JX294476), *Drosophila melanogaster* (AAL39784), *Daphnia pulicaria* (AAM76342), *Helicoverpa armigera* (ABS18391), *Homo sapiens* (NP 689808), *Heliothis virescens* (ABD76335), *Macdunnoughia crassisigna* (EU287451), *Macaca fascicularis* (AB179012), *Mus musculus* (NP 741958), *Pectinophora gossypiella* (GU270322), *Rattus norvegicus* (XP_220453), *Tribolium castaneum* (XP_001814566), *Trichoplusia ni* (AAA87375) and *Xenopus tropicalis* (BAF82026), although transposition activity has been described for almost none of these.

The terms "polynucleotide," "oligonucleotide," "nucleic acid" and "nucleic acid molecule" and "gene" are used interchangeably to refer to a polymeric form of nucleotides of any length, and may comprise ribonucleotides, deoxyribonucleotides, analogs thereof, or mixtures thereof. This term refers only to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the terms "polynucleotide," "oligonucleotide," "nucleic acid" and "nucleic acid molecule" include polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing nonnucleotidic backbones, for example, polyamide (for example, peptide nucleic acids ("PNAs")) and polymorpholino (commercially available from the Anti-Virals, Inc., Corvallis, Oreg., as Neugene) polymers, and other synthetic sequence-specific nucleic acid polymers providing that the polymers contain nucleobases in a configuration which allows for base pairing and base stacking, such as is found in DNA and RNA. There is no intended distinction in length between the terms "polynucleotide," "oligonucleotide," "nucleic acid" and "nucleic acid molecule," and these terms are used interchangeably herein. These terms refer only to the primary structure of the molecule. Thus, these terms include, for example, 3'-deoxy-2', 5'-DNA, oligodeoxyribonucleotide N3' P5' phosphoramidates, 2'-O-alkyl-substituted RNA, double- and single-stranded DNA, as well as double- and single-stranded RNA, and hybrids thereof including for example hybrids between DNA and RNA or between PNAs and DNA or RNA, and also include known types of modifications, for example, labels, alkylation, "caps," substitution of one or more of the nucleotides with an analog, internucleotide modifications such as, for example, those with uncharged linkages (for example, methyl phosphonates, phosphotriesters, phosphoramidates, carbamates, or the like) with negatively charged linkages (for example, phosphorothioates, phosphorodithioates, or the like), and with positively charged linkages (for example, aminoalkylphosphoramidates, aminoalkylphosphotriesters), those containing pendant moieties, such as, for example, proteins (including enzymes (for example, nucleases), toxins, antibodies, signal peptides, poly-L-lysine, or the like), those with intercalators (for example, acridine, psoralen, or the like), those containing chelates (of, for example, metals, radioactive metals, boron, oxidative metals, or the like), those containing alkylators, those with modified linkages (for example, alpha anomeric nucleic acids, or the like), as well as unmodified forms of the polynucleotide or oligonucleotide. Standard A-T and G-C base pairs form under conditions which allow the formation of hydrogen bonds between the N3-H and C4-oxy of thymidine and the N1 and C6-NH2, respectively, of adenosine and between the C2-oxy, N3 and C4-NH2, of cytidine and the C2-NH2, N'—H and C6-oxy, respectively, of guanosine. Thus, for example, guanosine (2-amino-6-oxy-9-.beta.-D-ribofuranosyl-purine) may be modified to form isoguanosine (2-oxy-6-amino-9-.beta.-D-ribofuranosyl-purine). Such modification results in a nucleoside base which will no longer effectively form a standard base pair with cytosine. However, modification of cytosine (1-.beta.-D-ribofuranosyl-2-oxy-4-amino-pyrimidi-ne) to form isocytosine (1-.beta.-D-ribofuranosyl-2-amino-4-oxy-pyrimidine-) results in a modified nucleotide which will not effectively base pair with guanosine but will form a base pair with isoguanosine (U.S. Pat. No. 5,681,702 to Collins et al.). Isocytosine is available from Sigma Chemical Co. (St. Louis, Mo.); isocytidine may be prepared by the method described by Switzer et al. (1993) Biochemistry 32:10489-10496 and references cited therein; 2'-deoxy-5-methyl-isocytidine may be prepared by the method of Tor et al. (1993) J. Am. Chem. Soc. 115:4461-4467 and references cited therein; and isoguanine nucleotides may be prepared using the method described by Switzer et al. (1993), supra, and Mantsch et al. (1993) Biochem. 14:5593-5601, or by the method described in U.S. Pat. No. 5,780,610 to Collins et. al. Other nonnatural base pairs may be synthesized by the method described in Piccirilli et al. (1990) Nature 343:33-37 for the synthesis of 2,6-diaminopyrimidine and its complement (1-methylpyrazolo-[4,3]pyrimidine-5,7-(4H,6H)-dione. Other such modified nucleotidic units which form unique base pairs are known, such as those described in Leach et al. (1992) J. Am. Chem. Soc. 114:3675-3683 and Switzer et al., supra.

A "PRE" is a Posttranscriptional Regulatory Element. Originally identified in the hepatitis B viruses of humans and woodchucks, these elements are believed to enhance expression by increasing export of transcripts from the nucleus.

A "promoter" means a nucleic acid sequence sufficient to direct transcription of an operably linked nucleic acid molecule. Also included in this definition are those transcription control elements (for example, enhancers) that are sufficient to render promoter-dependent gene expression controllable in a cell type-specific, tissue-specific, or temporal-specific manner, or that are inducible by external signals or agents; such elements, may be within the 3' region of a gene or within an intron. Desirably, a promoter is operably linked to a heterologous nucleic acid sequence, for example, a cDNA or a gene sequence, or an effector RNA coding sequence, in such a way as to enable expression of the nucleic acid sequence, or a promoter is provided in an expression cassette into which a selected nucleic acid sequence to be transcribed can be conveniently inserted.

The term "selectable marker" means a polynucleotide segment that allows one to select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions. Examples of selectable markers include but are not limited to: (1) DNA segments that encode products which provide resistance against otherwise toxic compounds (e.g., antibiotics); (2) DNA segments that encode products which are otherwise lacking in the recipient cell (e.g., tRNA genes, auxotrophic markers); (3) DNA segments that encode products which suppress the activity of a gene product; (4) DNA segments that encode products which can be readily identified (e.g., phenotypic markers such as beta-galactosidase, green fluorescent protein (GFP), and cell surface proteins); (5) DNA segments that bind products which are otherwise detrimental to cell survival and/or function; (6) DNA segments that otherwise inhibit the activity of any of the DNA segments described in Nos. 1-5 above (e.g., antisense oligonucleotides); (7) DNA segments that bind products that modify a substrate (e.g. restriction endonucleases); (8) DNA segments that can be used to isolate a desired molecule (e.g. specific protein binding sites); (9) DNA segments that encode a specific nucleotide sequence which can be otherwise non-functional (e.g., for PCR amplification of subpopulations of molecules); and/or (10) DNA segments, which when absent, directly or indirectly confer sensitivity to particular compounds.

The term "sequence alignment" refers to the result when at least two construct sequences are compared for maximum correspondence, as measured using sequence comparison algorithms. Optimal alignment of sequences for comparison can be conducted by any technique known or developed in the art, and the invention is not intended to be limited in the alignment technique used. Exemplary alignment methods include the local homology algorithm of Smith & Waterman, Adv. Appl. Math. 2:482 (1981), the homology alignment algorithm of Needleman & Wunsch, J. Mol. Biol. 48:443 (1970), the search for similarity method of Pearson & Lipman, Proc. Nat'l. Acad. Sci. USA 85:2444 (1988), by computerized implementations of these algorithms (e.g., GAP, BESTFIT, FASTA, and TFASTA in the Wisconsin Genetics Software Package, Genetics Computer Group, 575 Science Dr., Madison, Wis.), and by inspection.

Sequence identity can be determined by aligning sequences using algorithms, such as BESTFIT, FASTA, and TFASTA in the Wisconsin Genetics Software Package Release 7.0, Genetics Computer Group, 575 Science Dr., Madison, Wis.), using default gap parameters, or by inspection, and the best alignment (i.e., resulting in the highest percentage of sequence similarity over a comparison window). Percentage of sequence identity is calculated by comparing two optimally aligned sequences over a window of comparison, determining the number of positions at which the identical residues occurs in both sequences to yield the number of matched positions, dividing the number of matched positions by the total number of matched and mismatched positions not counting gaps in the window of comparison (i.e., the window size), and multiplying the result by 100 to yield the percentage of sequence identity. Unless otherwise indicated the window of comparison between two sequences is defined by the entire length of the shorter of the two sequences.

"Sequence variants" refers to variants of discrete constructs (that is constructs whose sequence can be uniquely defined) including nucleic acid construct and polypeptide and variants. Sequence variants are sequences that are related to one another or to a common nucleic acid or amino acid "reference sequence" but contain some differences in nucleotide or amino acid sequence from each other. These changes can be transitions, transversions, deletions, insertions, substitutions with non-naturally occurring nucleotides or amino acids (mimetics), exchanges or insertions of polynucleotide elements. The phrase "optimizing a sequence" refers to the process of creating nucleic acid variants so that the desired functionality and or properties of the nucleic acid are improved. One of skill will realize that optimizing a nucleic acid could involve selecting a variant with lower functionality than the parental protein if that is desired.

The term "translation" refers to the process by which a polypeptide is synthesized by a ribosome 'reading' the sequence of a polynucleotide.

A 'transposase' is a polypeptide that catalyzes the excision of a corresponding transposon from a donor polynucleotide, for example a vector, and (providing the transposase is not integration-deficient) the subsequent integration of the transposon into a target nucleic acid.

The term "transposition" is used herein to mean the action of a transposase in excising a transposon from one polynucleotide and then integrating it, either into a different site in the same polynucleotide, or into a second polynucleotide.

The term "transposon" means a polynucleotide that can be excised from a first polynucleotide, for instance, a vector, and be integrated into a second position in the same polynucleotide, or into a second polynucleotide, for instance, the genomic or extrachromosomal DNA of a cell, by the action of a corresponding trans-acting transposase. A transposon comprises a first transposon end and a second transposon end, which are polynucleotide sequences recognized by and transposed by a transposase. A transposon usually further comprises a first polynucleotide sequence between the two transposon ends, such that the first polynucleotide sequence is transposed along with the two transposon ends by the action of the transposase. Natural transposons frequently comprise DNA encoding a transposase that acts on the transposon. Transposons of the present invention are "synthetic transposons" comprising a heterologous polynucleotide sequence which is transposable by virtue of its juxtaposition between two transposon ends.

The term "transposon end" means the cis-acting nucleotide sequences that are sufficient for recognition by and transposition by a corresponding transposase. Transposon ends of piggyBac-like transposons comprise perfect or imperfect repeats such that the respective repeats in the two transposon ends are reverse complements of each other. These are referred to as inverted terminal repeats (ITR) or terminal inverted repeats (TIR). A transposon end may or may not include additional sequence proximal to the ITR that promotes or augments transposition.

The term "vector" or "DNA vector" or "gene transfer vector" refers to a polynucleotide that is used to perform a "carrying" function for another polynucleotide. For example, vectors are often used to allow a polynucleotide to be propagated within a living cell, or to allow a polynucleotide to be packaged for delivery into a cell, or to allow a polynucleotide to be integrated into the genomic DNA of a cell. A vector may further comprise additional functional elements, for example it may comprise a transposon.

4.2 Description 4.2.1 Gene Transfer System Components.

The functional properties of natural and non-natural biological systems depend on the interaction between multiple nucleic acid sequence elements, which may be located at positions throughout the total nucleic acid component of the system, herein referred to as the "nucleic acid construct" of the system. The ability to rationally design a nucleic acid construct with an optimal configuration of elements is advantageous for various applications such as protein synthesis via vector optimization, cell line development and strain engineering. Protein synthesis is a highly dynamic and multi-step process, and which plays a central role in synthetic biology, pharmaceutical production and other applications in biotechnology. This importance has led to the development of various parts or genetic control elements able to modulate and precisely control various aspects of protein expression. This capability is not only essential for the successful construction of more complex synthetic biological systems, but also provides tools needed for the tuning of their function for improved performance and reliability.

While effects of combinations of one or two transcriptional or translational elements have been studied including the genetic context in which they are used, there remains a need in the art to identify optimal configurations of multiple functional elements. Such elements can include those that influence DNA copy number, sites of DNA integration into chromosomes, RNA transcription rate, RNA degradation, RNA processing, RNA localization, translation initiation rate, and transcriptional termination. Examples of such elements are promoters, enhancers, introns, polyadenylation signals, ribosome binding sites, Kozak sequences, 5' untranslated sequences, 3' untranslated sequences, origins of replication, nuclear export signals, internal ribosome entry sites and transcriptional terminators. Functional elements may also include those that encode functional polypeptides, such as secretion signals, resistance markers, anchoring peptides, localization signals, fusion tags, affinity tags, chaperonins and proteases. The ability to rationally engineer multiple elements within the DNA content of a host cell or expression system is an important aspect of this invention.

In preferred embodiments, a gene transfer vector comprises expression elements capable of driving high levels of gene expression. In eukaryotic cells, gene expression is regulated by several different classes of elements, including enhancers, promoters, introns, RNA export elements, polyadenylation sequences and transcriptional terminators.

Gene transfer vectors for the transfer of genes for expression into mammalian cells may comprise an enhancer sequence. Advantageous gene transfer vectors comprise an enhancer sequence from immediate early genes 1, 2 or 3 of cytomegalovirus (CMV) from human, rodent or primate viruses (for example a sequence at least 95% identical to a sequence selected from SEQ ID NOS: 11-26); an enhancer from the adenoviral major late protein enhancer (for example a sequence at least 95% identical to SEQ ID NO: 27); or an enhancer from SV40 (for example a sequence at least 95% identical to SEQ ID NO: 28).

Gene transfer vectors for the transfer of genes for expression into mammalian cells may comprise a promoter sequence. Advantageous gene transfer vectors comprise a promoter for an EF1a gene from any mammalian or avian species including human, rat, mice, chicken or hamster (for example a sequence at least 95% identical to a sequence selected from SEQ ID NOS: 29-47); a promoter from the immediate early genes 1, 2 or 3 of cytomegalovirus (CMV) from human, primate or murine viruses (for example a sequence at least 95% identical to a sequence selected from SEQ ID NOS: 48-58); a promoter for the gene for eukaryotic elongation factor 2 (EEF2) from any mammalian or avian species including human, rat, mice, chicken or hamster (for example a sequence at least 95% identical to a sequence selected from SEQ ID NOS: 59-66); a promoter from an actin gene for any mammalian or avian species including human, rat, mice, chicken or hamster (for example a sequence at least 95% identical to a sequence selected from SEQ ID NOS: 67-76); a promoter for the glyceraldehyde dehydrogenase (GAPDH) gene from any mammalian species (for example a sequence at least 95% identical to a sequence selected from SEQ ID NO: 77-78); a promoter for a phosphoglycerate kinase (PGK) gene from any mammalian or avian species including human, rat, mice, chicken or hamster (for example a sequence at least 95% identical to a sequence selected from SEQ ID NOS: 79-82); or a ubiquitin promoter (for example a sequence at least 95% identical to SEQ ID NO: 83).

Gene transfer vectors for the transfer of genes for expression into mammalian cells may comprise an intron. Advantageous gene transfer vectors comprise an intron from immediate early genes 1, 2 or 3 of cytomegalovirus (CMV) from human, primate or murine viruses (for example a sequence at least 95% identical to a sequence selected from SEQ ID NOS: 91-105); an intron from the EF1a gene from any mammalian or avian species including human, rat, mice, chicken or hamster, (for example a sequence at least 95% identical to a sequence selected from SEQ ID NOS: 106-113); an intron from an EEF2 gene from any mammalian or avian species including human, rat, mice, chicken or hamster (for example a sequence at least 95% identical to a sequence selected from SEQ ID NOS: 114-121); an intron from an actin gene from any mammalian or avian species including human, rat, mice, chicken or hamster (for example a sequence at least 95% identical to a sequence selected from SEQ ID NOS: 122-135); an intron from a GAPDH gene from any mammalian or avian species including human, rat, mice, chicken or hamster (for example a sequence at least 95% identical to a sequence selected from SEQ ID NOS: 136-138); or an intron comprising the adenoviral major late protein enhancer for example a sequence at least 95% identical to a sequence selected from SEQ ID NO: 139-140).

Advantageous gene transfer vectors may comprise one or more combinations of promoters and introns in which a promoter from one gene is operably linked to an intron for a different gene, that is, the intron is heterologous to the promoter. For example an advantageous gene transfer vector comprises an immediate early CMV promoter from mouse, human or primates (for example a sequence selected from SEQ ID NOS: 48-58) operably linked to an intron from an EF1a gene from any mammalian or avian species including human, rat, mice, chicken or hamster, (for example a sequence at least 95% identical to a sequence selected from SEQ ID NOS: 106-113); or operably linked to an intron from an EEF2 gene from any mammalian or avian species including human, rat, mice, chicken or hamster (for example a sequence at least 95% identical to a sequence selected from SEQ ID NOS: 114-121); or operably linked to an intron from an actin gene from any mammalian or avian species including human, rat, mice, chicken or hamster (for example a sequence at least 95% identical to a sequence selected from SEQ ID NOS: 122-135).

Advantageous gene transfer vectors may comprise combinations of promoters and enhancers in which a promoter from one gene is operably linked to an enhancer for a different gene, that is, the enhancer is heterologous to the promoter. For example, an advantageous gene transfer vector comprises an immediate early CMV enhancer from mouse (for example a sequence at least 95% identical to a sequence selected from SEQ ID NOS: 21-25) or from human (for example a sequence at least 95% identical to a sequence selected from SEQ ID NOS: 11-20) or from primates (for example a sequence at least 95% identical to SEQ ID NO: 26) operably linked to a promoter from an EF1a gene from any mammalian or avian species including human, rat, mice, chicken or hamster, (for example a sequence at least 95% identical to a sequence selected from SEQ ID NOS: 29-47); or operably linked to a promoter from an EEF2 gene from any mammalian or avian species including human, rat, mice, chicken or hamster (for example a sequence at least 95% identical to a sequence selected from SEQ ID NOS: 59-66); or operably linked to a promoter from an actin gene from any mammalian or avian species including human, rat, mice, chicken or hamster (for example a sequence at least 95% identical to a sequence selected from SEQ ID NOS: 67-76). Advantageous gene transfer vectors for the transfer of genes for expression into mammalian cells may comprise a sequence at least 95% identical to a sequence selected from SEQ ID NOs: 142-191.

Advantageous gene transfer vectors for the transfer of genes for expression into mammalian cells may comprise an expression enhancer that facilitates RNA export from the nucleus such as post-transcriptional regulatory element from hepatitis viruses of woodchuck (WPRE), human (HPRE), ground squirrel (GPRE) or arctic ground squirrel (AGSPRE), (for example sequences at least 95% identical to a sequence selected from SEQ ID NOS: 228-231); or a synthetic post-transcriptional regulatory element such as a sequence at least 95% identical to a sequence selected from SEQ ID NOs: 232-292. These expression-enhancing elements are particularly advantageous when placed 3' of a sequence to be expressed.

Advantageous gene transfer vectors comprise a strong polyadenylation signal sequence. For example an advantageous gene transfer vector comprises a polyadenylation signal from an immediate early gene of CMV (for example a sequence at least 95% identical to a sequence selected from SEQ ID NOS: 192-197); a polyadenylation signals from a mammalian EF1a gene (for example sequences at least 95% identical to a sequence selected from SEQ ID NOs: 198-204); a polyadenylation signal from a mammalian growth hormone gene (for example a sequence at least 95% identical to a sequence selected from SEQ ID NOS: 205-209); a polyadenylation signal from a mammalian globin gene (for example a sequence at least 95% identical to a sequence selected from SEQ ID NOS: 210-216); a polyadenylation signal from a mammalian antibody gene (for example a sequence at least 95% identical to a sequence selected from SEQ ID NOS: 217-219); a polyadenylation signal from a mammalian antibody gene (for example a sequence at least 95% identical to a sequence selected from SEQ ID NOS: 217-219); or a polyadenylation signal from a highly expressed viral gene such as SV40 early or late genes or HSV-TK (for example a sequence at least 95% identical to a sequence selected from SEQ ID NOS: 220-227).

Advantageous gene transfer vectors may comprise untranslated regions (UTRs) placed at the 5' and 3' of the gene to be expressed (5'-UTRs and 3'-UTRs respectively). 5'- and 3'-UTRs may facilitate translational initiation, or contribute to mRNA stability, thereby enhancing gene expression.

The components of the gene transfer system may be transfected into one or more cells by techniques such as particle bombardment, electroporation, microinjection, combining the components with lipid-containing vesicles, such as cationic lipid vesicles, DNA condensing reagents (example, calcium phosphate, polylysine or polyethyleneimine), and inserting the components (that is the nucleic acids thereof into a viral vector and contacting the viral vector with the cell. Where a viral vector is used, the viral vector can include any of a variety of viral vectors known in the art including viral vectors selected from the group consisting of a retroviral vector, an adenovirus vector or an adeno-associated viral vector. The gene transfer system may be formulated in a suitable manner as known in the art, or as a pharmaceutical composition or kit.

4.2.2 Gene Transfer System Component Combinations.

Many different types of parts capable of controlling transcriptional and translational aspects of the protein synthesis process have been developed. At the transcriptional level, libraries of promoters have been created spanning a wide range of expression levels (Mey et. al., 2007 BMC Biotechnology; Hartner et. al., 2008 Nucleic Acids Research) and efforts have been made to understand potential rules governing promoter structure (Blount et. al., 2012 PLoS One 7; Blazeck et. al., 2013 Biotechnology Journal; Lubliner et. al., 2013 Nucleic Acids Research). At the translational level, libraries of ribosome binding sites (RBSs) have been generated (Mutalik et. al., 2013 Nature Methods) and some rational approaches developed (Salis et. al., 2009 Nature Biotechnology). Biophysical models of interactions between the ribosome and mRNA have successfully been used to predict relative ribosome initiation strengths and applied in a forward-engineering mode to suggest potential RBS sequences with a desired strength (Salis et. al., 2009 Nature Biotechnology). In addition to RBSs, the speed of translation has been found to be strongly influenced by synonymous codon usage within the gene being expressed. Changes in codon usage have been shown to strongly affect overall expression levels (Welch et. al., 2009 PLoS; Kudla et. al., 2009 Science), influence correct folding of active proteins (Zhang et. al., 2009 Nature Structural and Molecular Biology), and to enable dynamic responses to environmental stresses (Wohlgemuth et. al., 2013 Nucleic Acids Research).

An embodiment of the present invention provides a method for constructing an expression vector including a combination of element sequences that have undergone optimization for expression of an open reading frame or RNA-encoding sequence within the vector. In the method, a plurality of sequence element groups are identified. Optionally these element groups correspond to functional categories, for example a group of enhancer sequences, a group of promoter sequences, a group of intron sequences, a group of RNA export element sequences, a group of insulator sequences, a group of polyadenylation signal sequences, a group of 5'-UTR sequences, a group of 3'-UTR sequences and so on. For each respective element group, one or more elements are identified, for example as described in Section 4.2.1. Thus, there are one or more enhancer elements, one or more promoter elements, one or more intron elements, one or more RNA export elements, one or more insulator elements, one or more polyadenylation signal elements, one or more 5'-UTR elements, one or more 3'-UTR elements and so on. Typically there is variation in at least two sequence element groups. The possible combinations of the plurality of element groups and of the elements within each group collectively define an expression vector sequence-space. A variant set is selected from the expression vector sequence-space such that the variant set comprises a plurality of variants that are a subset of the expression vector sequence space. In preferred embodiments the variant set is selected using a Design of Experiment algorithm, such as Fedorov exchange algorithm for D-optimal experimental designs (FEADO) (Fedorov, V. V.: Theory of Optimal Experiments. Academic Press, New York (1972). Transl. and ed. by W. J. Snudden, E. M. Klimko or a related experimental design algorithm (see for example Smucker, B. J. et. al., 2011. "Exchange algorithms for constructing model-robust experimental designs" J. Quality Technol. 43: 1-15). All or a portion of the variants in the variant set are constructed (e.g., at least 2, 5, 10, 15, 25, 50, 100, 1000 or 10,000 variants) and operably linked to a heterologous second polynucleotide that includes an open reading frame or RNA-encoding sequence to be expressed forming an "expression gene." Expression of the expression gene is measured. A sequence-activity relationship is modeled between (i) the identities of the sequence elements in each expression vector in the variant set and (ii) the expression of the expression gene. The variant set is then redefined to comprise variants that include elements in the plurality of elements that are selected based on a function of the sequence-activity relationship.

Optionally the same or a different expression vector variant set are constructed and operably linked to a heterologous third polynucleotide that encodes a second open reading frame or RNA-encoding sequence forming a second expression gene. In this way it is possible to identify and/or eliminate and/or select vector elements whose effect is dependent upon the sequence of the gene being expressed.

The present invention allows the assessment of the effects of different types of elements: those that affect transcription, those that affect RNA processing, those that affect RNA export from the nucleus of the cell, those that affect integration into the host genome, those that affect replication within the host cell, those that affect translational initiation, those that affect translational elongation and those that affect mRNA stability. The present invention allows sets of polynucleotide constructs to be designed to test the interactions of these types of elements.

Gene transfer variant sets may be tested for performance in many dimensions in addition to expression of the expression gene. For example, they may be tested for viral packaging. The expression of a polypeptide may be measured in cells derived from many different tissues and may include primary cells or cultured cells. Such cells may be derived from preferred vertebrate cells include cells from mammals including, but not limited to, rodents, such as rats or mice, ungulates, such as cows or goats, sheep, swine or cells from a human. Target cells also include without being limited thereto, lymphocytes, hepatocytes, neural cells, muscle cells, a variety of blood cells, and a variety of cells of an organism, embryonic stem cells, somatic stem cells e.g. hematopoietic cells, embryos, zygotes, sperm cells (some of which are open to be manipulated by an in vitro setting) and cells of the human joints such as mesenchymal stem cells, synovial cells (including macrophage-like or fibroblast-like synovial cells). In other further exemplary embodiments, such cells, particularly cells derived from a mammal as defined above, can be pluripotent (i.e., a cell whose descendants can differentiate into several restricted cell types, such as hematopoietic stem cells or other stem cells) and totipotent cells (i.e., a cell whose descendants can become any cell type in an organism, e.g., embryonic stem cells).

Assessment of the effects of sequence elements upon expression of the expression gene can be performed by deriving a sequence-activity relationship. Such a relationship can be expressed very generally, for example as shown in Equation 1:

$$Y=f(x_1,x_2,\ldots x_i) \quad \text{(Eq 1)}$$

where,

Y is a quantitative measure of an expression, xi is a descriptor of a sequence element, a combination of elements, or a component of one or more elements in the sequence of the expression vector, and f( ) is a mathematical function that can take several forms.

A model of the sequence-activity relationship can be described as a functional form whose parameters have been trained for the input data (Y and $x_i$). Vector sequences can be mathematically represented in terms of many variables (descriptors, predictors), each variable representing the type of element at a specific location in the vector.

In equation 1, the functional form f( ) correlates descriptors of the elements in an expression vector ($x_i$) to its activity. In a simple embodiment of the invention, the function f can be a linear combination of $x_i$ as shown in Equation 2:

$$Y=w_1x_1+w_2x_2+\ldots w_ix_i \quad \text{(Eq. 2)}$$

where $w_i$ is a weight (or coefficient of $x_i$).

In some embodiments, to derive a sequence-activity relationship, a set of descriptors ($x_i$) that can describe all of the elements within the vector variant set is identified. Values of Y (for example expression level of a gene expressed from the vector) for each member of the vector variant set are measured. Values for each weight ($w_i$) are then calculated such that the differences between values predicted for each value of Y by Equations 1 or 2 and those observed experimentally are minimized for the vector variant set, or for a selected subset of such vector variants.

The minimization step above can also use weights for different activity predictions and, in general, can use a loss function. In one embodiment this loss function can be squared error loss, where weights that minimize the sum of squares of the differences between predicted and measured values for the dataset are computed.

In some embodiments statistical regression methods are used to identify relationships between dependent ($x_i$) and independent variables (Y). Such techniques include, but are not limited to, linear regression, non-linear regression, logistic regression, multivariate data analysis, and partial least squares regression. See, for example, Hastie, *The Elements of Statistical Learning*, 2001, Springer, New York; Smith, Statistical Reasoning, 1985, Allyn and Bacon, Boston. In one embodiment, regression techniques like the PLS (Partial Least Square) can be used to solve for the weights ($w_i$) in the equation X. Partial Least Squares (PLS) is a tool for modeling linear relationships between descriptors. The method is used to compress the data matrix composed of descriptors (variables) of vector variant elements being modeled into a set of latent variable called factors. The number of latent variable is much smaller than the number of variables (descriptors) in the input element data. For example, if the number of input variables is 100, the number of latent variables can be less than 10. The factors are determined using the nonlinear iterative partial least squares algorithm. The orthogonal factor scores are used to fit a set of activities to the dependent variables. Even when the predictors are highly collinear or linearly dependent, the method finds a good model. Alternative PLS algorithms like the SIMPLS can also be used for regression. In such methods, the contribution to the activities from every variable can be deconvoluted to study the effect of sequence elements on the function of the vector.

In some embodiments, modeling techniques are used to derive sequence-activity relationships. Such modeling techniques include linear and non-linear approaches. Linear and non-linear approaches are differentiated from each other based on the algebraic relationships used between variables and responses in such approaches. In the system being modeled, the input data (e.g., variables that serve as descriptors of the vector sequence/component elements), in turn, can be linearly related to the variables provided or non-linear combinations of the variables. It is therefore possible to perform different combinations of models and data-types: linear input variables can be incorporated into a linear model, non-linear input variables can be incorporated into a linear model and non-linear variables can be incorporated into a non-linear model.

In some embodiments, supervised learning techniques are used to identify relationships between elements in the variant set and vector properties identified by measured expression levels. Such supervised learning techniques include, but are not limited to, Bayesian modeling, nonparametric techniques (e.g., Parzen windows, $k_n$-Nearest-Neighbor algorithms, and fuzzy classification), neural networks (e.g., hopfield network, multilayer neural networks and support vector machines), and machine learning algorithms (e.g., algorithm-independent machine learning). See, for example, Duda et al., *Pattern Classification*, $2^{nd}$ edition, 2001, John Wiley & Sons, Inc. New York; and Pearl, *Probabilistic Reasoning in Intelligent Systems: Networks of Plausible Inference*, Revised Second Printing, 1988, Morgan Kaufmann, San Francisco. For example, the sequence ($x_i$)-activity (Y) data can be used to predict the activities of any sequence given the descriptors for a sequence using a neural network. The input for the network is the descriptors and the output is the predicted value of Y. The weights and the activation function can be trained using supervised decision-based learning rules. The learning is performed on a subset of variants called the training set and performance of the network is evaluated on a test set.

In some embodiments, unsupervised learning techniques are used to identify relationships between elements in the variant set and vector properties identified by measured expression levels. Such unsupervised learning techniques include, but are not limited to stochastic searches (e.g., simulated annealing, Boltzmann learning, evolutionary methods, principal component analysis, and clustering methods). See, for example, Duda et al., *Pattern Classification*, $2^{nd}$ edition, 2001, John Wiley & Sons, Inc. New York. For example, the weights in equation 5 can be adjusted by using monte carlo and genetic algorithms. The optimization of weights for non-linear functions can be complicated and no simple analytical method can provide a good solution in closed form. Genetic algorithms have been successfully used in search spaces of such magnitude. Genetic algorithms and genetic programming techniques can also be used to optimize the function form to best fit the data. For instance, many recombinations of functional forms applied on descriptors of the sequence variants can be applied.

In some embodiments, boosting techniques are used to construct and/or improve models developed using any of the other techniques described herein. A model of the sequence-activity relationship can be described as a functional form whose parameters have been trained for the input data (Y and $x_i$). Many algorithms/techniques to build models have been described. Algorithms applied on a specific dataset can be weak in that the predictions can be less accurate or "weak" (yielding poor models). Models can be improved using boosting techniques. See, for example, Hastie et al., *The Elements of Statistical Learning*, 2001, Springer, New York. The purpose of boosting is to combine the outputs of many "weak" predictors into a powerful "committee." In one embodiment of the invention, boosting is applied using the AdaBoost algorithm. Here, the prediction algorithm is sequentially applied to repeatedly modified versions of the data thereby producing a sequence of models. The predictions from all of these models are combined through a weighted majority vote to produce the final prediction. The data modification at each step consists of applying weights ($W^b_i$) to each of the i training observations. Initially weights are set to 1/N, where N is the number of training observation (sequence-activity data). The weights are modified individually in each successive iteration. Training observations that were predicted poorly by a particular model have their weights increased and training observations that were predicted more accurately have their weights decreased. This forces each successive model to concentrate on those training observations that are issued by the previous model. The step of combining the models to produce a "committee" assigns a weight to each model based on the overall prediction error of that model.

The models developed using various algorithms and methods can be evaluated by cross validation methods. For example, randomly leaving data out to build a model and making predictions of data not incorporated into the model is a standard technique for cross validation. In some instances, data may be generated over a period of months. The data can be added incrementally to the modeling procedure as and when such data becomes available. This can allow for validation of the model with partial or additional datasets, as well as predictions for the properties of vectors for which activities are still not available. This information may then be used to validate the model.

In one embodiment of the present invention, average values for and standard deviations of descriptor-weights can be obtained by omitting a part of the available data. For example, individual vectors and their associated activities can be left out. A sequence-activity relationship can then be constructed from this partial data. This process can be repeated many times, each time the data to leave out is selected randomly. From this process an average, range of values and standard deviation for each descriptor weight can be calculated. Descriptor weights can be ranked in order of the magnitude of their effect on vector activity, thereby identifying the descriptors, and thus the sequence elements that have the most significant effect on the vector. Similarly, descriptor weights can be evaluated according to how consistently they contribute to vector activity. A large average descriptor weight that also has a large standard deviation indicates a descriptor that is inconsistent in its effect on vector activity, suggesting for example significant context dependence. In contrast, a smaller average descriptor weight that is accompanied by a smaller standard deviation may indicate a more reliable effect on vector activity. An element is generally advantageous relative to the other members of a set of elements in a vector variant set if its average descriptor weight minus the standard deviation of the descriptor weight is greater than zero.

An example of how modelling may be used to identify an advantageous combination of sequence elements is as follows. First, identify a plurality of sequence element groups, and for each respective sequence element group select one or more element sequences. The possible combinations of the plurality of sequence element groups and the one or more element sequences for each respective sequence element group in the plurality of sequence element groups collectively define an expression vector sequence-space. Second, select a first plurality of variants of expression vectors thereby forming a variant set, wherein the variant set comprises a subset of the expression vector sequence-space. Third, measure expression of one or more genes from a portion of the variants in the variant set. Fourth model, using a suitably programmed computer, a sequence-activity relationship between (i) one or more element sequences in one or more element groups of the nucleic acid construct represented by the variant set and (ii) the gene expression measured for all or the portion of the variants in the variant set. The sequence-activity relationship may have the form of equation 1 or equation 2, and the modelling comprises (i) optimizing, using a suitably programmed computer, the sequence-activity relationship by adjusting individual weights $w_i$ for each the descriptor $x_i$ using a refinement algorithm that minimizes the difference between the predicted values and the real values of Y from partial data, wherein the partial data is the first plurality of variants with individual sequences left out on a random basis, and (ii) repeating the optimizing (i) a plurality of times thereby obtaining, for each respective element or combination of elements or component of elements $x_i$ (a) an average value for the weight $w_i$ describing a relative or absolute contribution of the respective element or combination of elements or component of elements $x_i$ to Y, and (b) a standard deviation, variance or other measure of variability of the weight $w_i$ describing the relative or absolute contribution of the respective element or combination of elements or component of elements $x_i$ to Y. Fifth, define a new expression vector that comprises one or more elements for which a descriptor $x_i$ has a weight $w_i$ whose mean value minus its standard deviation is greater than zero.

The present methods can be computer-implemented, such that any or all of the steps described in the specification or appended claims other than wet chemistry steps can be performed in a suitable programmed computer. The computer can be a mainframe, personal computer, tablet, smart phone, cloud, online data storage, remote data storage, or the like. The computer can be operated in one or more locations.

A computer program for analyzing a nucleic acid population can include codes for performing any of the steps other than wet chemistry steps described in the specification or in the appended claims. The computer program can also include codes for receiving sequence data from a database or sequencing apparatus and outputting calculated data to a display or printer.

The present methods can be implemented in a system (e.g., a data processing system). The system can also include a processor, a system bus, a main memory and optionally an auxiliary memory coupled to one another to perform one or more of the steps described in the specification or appended claims. The system can also include a display or printer for outputting results, a keyboard and/or pointer for providing user input, such as setting thresholds or defined proximities, among other accessories.

Various steps of the present methods can utilize information and/or programs and generate results that are stored on computer-readable media (e.g., hard drive, auxiliary memory, external memory, server; database, portable memory device (e.g., CD-R, DVD, ZIP disk, flash memory cards), and the like. For example, information used for and results generated by the methods that can be stored on computer-readable media.

The disclosure can be implemented in hardware and/or software. For example, different aspects of the disclosure can be implemented in either client-side logic or server-side logic. The disclosure or components thereof can be embodied in a fixed media program component containing logic instructions and/or data that when loaded into an appropriately configured computing device cause that device to perform according to the disclosure. A fixed media containing logic instructions can be delivered to a viewer on a fixed media for physically loading into a viewer's computer or a fixed media containing logic instructions may reside on a remote server that a viewer accesses through a communication medium to download a program component.

An example of use of modeling to identify advantageous combinations of sequence elements is given in Example 5.1.

4.2.3 Expression Tuning in Gene Transfer Systems.

It is often useful to be able to encode more than one gene on a single polynucleotide and introduce this construct into a recipient cell. In some cases, the more than one gene are integrated into the recipient cell genome (for example by random integration, or by the action of a transposase). It is frequently desirable to control the expression of the two or more genes independently. For example, in the production of monoclonal IgG antibodies two chains must be produced in approximately equal amounts but with a slight excess of light chain; in the production of monoclonal IgM molecules three chains must be produced with one chain at a level about 5-fold lower than the other two chains; in the production of bi-specific or tri-specific molecules, three or four chains must be produced at ratios that depend upon the precise nature of the different chains.

Tuning the relative expression of multiple genes introduced into a single cell is challenging for several reasons. For example, it is important to control the ratios of the genes themselves that are introduced. For constructs that are integrated into a recipient cell genome by random integration such control is very difficult, as the process involves random fragmentation of the polynucleotide that is introduced into the cell. There is thus a high chance that not all of the genes will be integrated, or that some parts of the polynucleotide will be concatemerized during integration. This problem can be overcome by the use of transposons including piggyBac-like transposons, for which there are transposases which integrate all sequences between the transposon ITRs into the recipient cell genome, thereby ensuring that the genes are integrated in the same configuration in which they are organized in the transposon.

Another challenge in tuning the relative expression of multiple genes is that it is difficult to predictably modify the expression of only one gene within a construct designed to express multiple genes. For example, switching the promoter or enhancer element that controls expression of one gene in a construct will often have a large and unpredictable impact on expression of other genes on the construct due to such effects as promoter interference.

PRE elements offer an alternative precisely targeted means of manipulating expression of individual genes relatively independently, because they primarily affect the transcript in which they occur. A transcript comprising a PRE element is differentially exported from the cell nucleus relative to a similar transcript that does not comprise a PRE element, and transcripts comprising different PRE elements are differentially exported from the nucleus relative to one another.

Example 5.1 describes many different non-natural PRE elements, including SEQ ID NOs: 242-292 and shows that these different PRE elements differ in the degree to which they enhance expression. Advantageous non-natural PRE elements comprise an alpha PRE sub-element selected from SEQ ID NOs 301-307. Advantageous PRE elements comprise a beta PRE sub-element selected from SEQ ID NOs 308-316. Advantageous PRE elements may comprise a gamma PRE sub-element selected from SEQ ID NOs 297-300. Advantageous PRE elements may comprise a delta PRE sub-element selected from SEQ ID NOs 293-296. Advantageous non-naturally occurring PRE elements may comprise an alpha, beta, gamma and delta PRE sub-element derived from one natural source, and an alpha, beta, gamma and delta PRE sub-element derived from a different natural source. Other advantageous PRE elements that are not naturally occurring sequences include a sequence selected from SEQ ID NOs: 228, 233-238 and 240. The non-naturally occurring PRE elements described herein may be incorporated into a polynucleotide and operably linked to a heterologous promoter or a heterologous open reading frame or RNA-encoding sequence to modulate expression of an operably linked open reading frame or RNA-encoding sequence, typically heterologous to the PRE. One or more non-natural PRE elements described herein may be incorporated into a polynucleotide encoding two or more open reading frames or RNA-encoding sequence, wherein a different PRE element is operably linked to two or more of the open reading frames or RNA-encoding sequences, in order to modulate the relative expression of those two or more open reading frames or RNA-encoding sequences. Either or both PRE elements can be heterologous to either or both open reading frames. In some embodiments of the invention, a polynucleotide for the expression of a gene comprises a selected from SEQ ID NOs: 293-316 operably linked to a heterologous promoter or a heterologous open reading frame or RNA-encoding sequence. In some embodiments a polynucleotide for the expression of a gene comprises a non-naturally occurring sequence selected from SEQ ID NOs: 293-316 operably linked to a heterologous promoter or a heterologous open reading frame.

In some embodiments of the invention, a polynucleotide for the expression of a gene comprises a sequence selected from SEQ ID NOs: 242-292 operably linked to a heterologous promoter or a heterologous open reading frame. In some embodiments of the invention, a polynucleotide for the expression of a gene comprises a non-naturally occurring sequence selected from SEQ ID NOs: 242-292 operably linked to a heterologous promoter or a heterologous open reading frame or RNA-encoding sequence.

The PRE elements described herein possess a range of expression-enhancing activities. They are therefore useful for controlling the relative expression of two or three or four or more polypeptides. In some embodiments of the invention, a polynucleotide for the expression of two or more polypeptides comprises a non-natural PRE element. In some embodiments of the invention, a polynucleotide for the expression of two or more polypeptides comprises a non-natural PRE element selected from SEQ ID NOs: 228-292, operably linked to a heterologous promoter or a heterologous open reading frame or RNA-encoding sequence. In some embodiments of the invention, a polynucleotide for the expression of two or more polypeptides comprises two different PRE elements, each one operably linked to a heterologous promoter or a heterologous open reading frame or RNA-encoding sequence. In some embodiments of the invention, one of the PRE elements is selected from SEQ ID NOs: 228-292. In some embodiments of the invention, one of the PRE elements is SEQ ID NO: 240.

4.2.4 AAV Gene Transfer Systems.

Gene transfer systems that use adeno-associated virus (AAV) comprise two ITRs in inverted orientation with respect to each other. Exemplary ITR sequences are given as SEQ ID NOs: 1-6. The amount of DNA that can be packaged into an AAV virion is strictly limited to a total of approximately 4.7 kb, including the ITRs. It is thus advantageous to pack the regulatory elements between the ITRs as efficiently as possible, but without compromising the functioning of any of these elements. Thus, for an example, an open reading frame or RNA-encoding sequence operably linked to regulatory element(s) can be flanked on one side by any of SEQ ID NO:s. 1-6 in forward (normal) orientation and on the other side by any of SEQ ID NOS. 1-6 in reverse orientation. Preferably, the same SEQ ID NO. is used in forward and reverse orientation.

An AAV vector variant set was cloned between a pair of AAV ITRs (SEQ ID NO: 3) oriented in opposite directions. The ITRs were cloned into a vector backbone comprising a gene conferring kanamycin resistance in E. coli and an origin of replication active in E. coli (SEQ ID NO. 319). This vector backbone is an aspect of the invention. In some embodiments the vector backbone further comprises a counter-selectable marker, in some embodiments the counter-selectable marker is sacB, rpsL, tetAR, pheS, thyA, lacY, gata-1, ccdB, kid or barnase. Other exemplary AAV vector backbone sequences include a sequence selected from SEQ ID NO: 317-322.

For an open reading frame or RNA-encoding sequence to be expressed from an AAV gene transfer system, it is advantageous for the open reading frame or RNA-encoding sequence to be operably linked to enhancer, promoter and intron elements, with these elements being positioned to the 5' of the open reading frame or RNA-encoding sequence to be expressed along with one of the AAV ITRs. An advantageous AAV gene transfer system comprises a polynucleotide comprising a sequence selected from SEQ ID NOs 323-432. For an open reading frame or RNA-encoding sequence to be expressed from an AAV gene transfer system, it is advantageous for the open reading frame or RNA-encoding sequence to be operably linked to polyadenylation elements, and elements that enhance RNA export from the nucleus such as PRE elements, with these elements being positioned to the 3' of the gene to be expressed. An advantageous AAV gene transfer system comprises a polynucleotide comprising a sequence selected from SEQ ID NOs 433-456. It may also be advantageous for the size of the DNA to be packaged within the AAV viral particle to be as close to the optimal size as possible. For this reason, it is advantageous to include an inert "stuffer" sequence to the 3' of the regulatory sequences operably linked to the gene. The stuffer sequence should not be prone to silencing, and so should not comprise a high frequency of CpG dinucleotides; it should not comprise promoter or enhancer elements, and it should not comprise open reading frames greater than 50 or 100 amino acids long. Examples of such sequences include SEQ ID NO: 496-499. Advantageous AAV gene transfer systems comprise a polynucleotide comprising at least 100 contiguous bases, or at least 200 contiguous bases, or at least 300 contiguous bases, or at least 400 contiguous bases, or at least 500 contiguous bases, or at least 600 contiguous bases, or at least 700 contiguous bases, or at least 800 contiguous bases, or at least 900 contiguous bases, or at least 1,000 contiguous bases from a sequence selected from SEQ ID NOs: 496-499, so that the sequence of the entire AAV gene transfer nucleic acid construct from the beginning of one ITR to the end of the second ITR is between 4,800 bp and 4,400 bp, more preferably between 4,700 bp and 4,500 bp. Examples of combinations of 3' regulatory sequences, stuffer sequences and AAV ITRs include SEQ ID Nos 457-495. An advantageous AAV gene transfer system comprises a polynucleotide comprising a sequence selected from SEQ ID NOs 457-495.

4.2.5 Gene Transfer Systems Using Glutamine Synthetase.

Glutamine synthetase (GS) can be used as a selectable marker that allows selection via glutamine metabolism. Glutamine synthetase is the enzyme responsible for the biosynthesis of glutamine from glutamate and ammonia and is a crucial component of the only pathway for glutamine formation in a mammalian cell. In the absence of glutamine in the growth medium, the GS enzyme is essential for the survival of mammalian cells in culture. Some cell lines, for example mouse myeloma cells do not express sufficient GS enzyme to survive without added glutamine. In these cells, a transfected GS gene can function as a selectable marker by permitting growth in a glutamine-free medium. In other cell lines, for example Chinese hamster ovary (CHO), cells express sufficient GS enzyme to survive without exogenously added glutamine. These cell lines can be manipulated by genome editing techniques including CRISPR/Cas9, AAV and TALENs to reduce or eliminate the activity of the GS enzyme.

Selection protocols include introducing a gene transfer polynucleotide comprising sequences encoding a glutamine synthetase selectable marker, and a gene encoding a first polypeptide. Preferably, the polynucleotide encoding glutamine synthetase is operably linked to a weak promoter or other sequence elements so that only low GS expression can result from a single genomic copy of the gene. In this case, sufficient glutamine synthetase expression to allow the cell to survive can only occur if many copies of the gene transfer polynucleotide are present, or if they are integrated in a position in the genome where high levels of expression occur. Since the polynucleotide also comprises a gene encoding a first polypeptide, the gene encoding the first polypeptide is also present in many copies or in genomic positions where high levels of expression occur, so many of the surviving cells also show an increased expression of the first polypeptide.

It is often advantageous to operably link the polynucleotide encoding the glutamine synthetase to expression control elements that result in low levels of expression of the glutamine synthetase. Low expression levels of the glutamine synthetase may be achieved by using a weakly active constitutive promoter such as the phosphoglycerokinase (PGK) promoter (e.g. a sequence selected from SEQ ID NOs: 79-82), the Herpes Simplex Virus thymidine kinase (HSV-TK) promoter (e.g. a sequence selected from SEQ ID NO: 84-85), the MC1 promoter (for example SEQ ID NO: 86), the ubiquitin promoter (for example SEQ ID NO: 83). Other weakly active promoters may be deliberately constructed, for example a promoter attenuated by truncation, such as a truncated SV40 promoter (for example a sequence selected from SEQ ID NO: 87-88), or a promoter attenuated by insertion of a 5'UTR unfavorable for expression between a promoter and the polynucleotide encoding the selectable polypeptide, for example a sequence selected from SEQ ID NOs: 500-501. Examples of attenuated promoters include an attenuated PGK promoter (SEQ ID NO: 89) and an attenuated HSV-TK promoter (SEQ ID NO: 90). Particularly advantageous gene transfer polynucleotides comprise a promoter sequence that is at least 90% identical or at least 95% identical or at least 99% identical to any of SEQ ID NOs: 83-90, operably linked to a polynucleotide encoding a glutamine synthetase.

Expression levels of a selectable marker may also be advantageously reduced by other mechanisms such as the insertion of the SV40 small t antigen intron after the gene for the selectable marker. The SV40 small t intron accepts aberrant 5' splice sites, and can lead to deletions within the preceding gene in a fraction of the spliced mRNAs, thereby reducing expression of the selectable marker. Particularly advantageous gene transfer polynucleotides comprise intron SEQ ID NO: 141, operably linked to a gene encoding a glutamine synthetase. For this mechanism of attenuation to be effective, it is preferable for the gene encoding the glutamine synthetase to comprise a strong intron donor within its coding region, and for the intron to be located to the 3' of the open reading frame of the glutamine synthetase gene.

Glutamine synthetase genes from a variety of sources may be used to provide glutamine synthetase activity in CHO cells. The natural gene from CHO (SEQ ID NO: 503) may be used, it may be encoded by the sequence SEQ ID NO: 509 which comprises a strong intron donor. The natural gene from rat (SEQ ID NO: 504) may be used, it may be encoded by the sequence SEQ ID NO: 510 which comprises a strong intron donor. A modified gene from hamster (SEQ ID NO: 506) may be used, it may be encoded by the sequence SEQ ID NO: 512 which comprises a strong intron donor. A modified gene from mouse (SEQ ID NO: 505) may be used, it may be encoded by the sequence SEQ ID NO: 511 which comprises a strong intron donor. Advantageous gene transfer polynucleotides comprise a gene encoding a glutamine synthetase enzyme comprising an amino acid sequence selected from SEQ ID NO: 503-508.

Glutamine synthetase enzymes may be reduced in activity by changes to their amino acid sequences. Reduction can be between 10% and 90%% relative to a natural glutamine synthetase from which the modified glutamine synthetase was derived. In some instances, these changes may be amino acid changes within the glutamine synthetase sequence, in other instances these changes may be in their regulatory elements. For example, the naturally occurring hamster glutamine synthetase sequence (SEQ ID NO: 507) may be reduced in activity by incorporating the changes D92E, R213H and R282Q: this produces glutamine synthetase sequence SEQ ID NO: 506. The naturally occurring mouse glutamine synthetase sequence (SEQ ID NO: 508) may be reduced in activity by incorporating the changes: V26I, E50D and G320S: this produces glutamine synthetase sequences SEQ ID NO: 505. The mammalian glutamine synthetase enzyme is a homodecamer (comprised of 10 identical subunits). The precise fitting together of these subunits is important for function. The activity of mammalian glutamine synthetase enzymes can be reduced by adding a C-terminal extension to the enzyme that interferes with the interactions between protein subunits. An example of a C-terminal extension that reduces the activity of mammalian glutamine synthetases is SEQ ID NO: 502. Advantageous gene transfer polynucleotides comprise a glutamine synthetase enzyme comprising SEQ ID NO: 502 at the C-terminus. Examples of glutamine synthetase sequences with reduced activity resulting from the addition of a C-terminal extension comprising SEQ ID NO: 502 are SEQ ID NOs: 513-518. Advantageous gene transfer polynucleotides comprise a gene encoding a glutamine synthetase enzyme which comprises a sequence selected from SEQ ID NOs: 513-518. Advantageous gene transfer polynucleotides comprise a gene encoding a glutamine synthetase enzyme comprising a sequence selected from SEQ ID NO: 509-512.

Advantageous gene transfer vectors comprise a gene encoding glutamine synthetase and further comprise a gene to be expressed, for example they comprise a promoter operably linked to a heterologous open reading frame that does not encode a glutamine synthetase enzyme. Advantageous gene transfer vectors comprising a gene encoding glutamine synthetase may further comprise two genes to be expressed, for example they comprise a first promoter operably linked to a first heterologous open reading frame, and a second promoter operably linked to a second heterologous open reading frame, wherein the first and second heterologous open reading frames do not encode a glutamine synthetase enzyme.

Expression levels of glutamine synthetase may also be reduced by other mechanisms such as insertion of an inhibitory 5'-UTR within the transcript, for example a sequence selected from SEQ ID NO: 500-501. Particularly advantageous gene transfer polynucleotides comprise a promoter operably linked to a polynucleotide encoding a glutamine synthetase, wherein a sequence that is at least 90% identical or at least 95% identical or at least 99% identical to a sequence selected from SEQ ID NO: 500-501 is interposed between the promoter and the open reading frame of the glutamine synthetase gene.

Combinations of weak promoters with a glutamine synthetase gene include a sequence selected from SEQ ID NOs: 519-528. Combinations of weak promoters with a glutamine synthetase gene and an SV40 t intron include a sequence selected from SEQ ID NOs: 529-535. Combinations of weak promoters with an attenuating 5' UTR and a glutamine synthetase gene include a sequence selected from SEQ ID NOs: 536-537. Combinations of weak promoters with an attenuating 5' UTR, a glutamine synthetase gene and an SV40 t intron include a sequence selected from SEQ ID NOs: 538-542. Combinations of weak promoters with an attenuating 5' UTR, a glutamine synthetase gene with a C-terminal extension and an SV40 t intron include a sequence selected from SEQ ID NOs: 543-547. Combinations of weak promoters, a glutamine synthetase gene with a C-terminal extension and an SV40 t intron include a sequence selected from SEQ ID NOs: 548-551. Combinations of weak promoters with an attenuating 5' UTR and a glutamine synthetase gene with a C-terminal extension include SEQ ID NO: 552. Combinations of weak promoters and a glutamine synthetase gene with a C-terminal extension include a sequence selected from SEQ ID NOs: 553-556. Advantageous gene transfer polynucleotides comprise a polynucleotide encoding a glutamine synthetase enzyme and operably linked regulatory elements that comprise a sequence selected from SEQ ID NOs: 519-556.

In order for the expression cell to produce sufficient levels of glutamine synthetase from an attenuated glutamine synthetase, it is advantageous for the gene transfer polynucleotide to be present in a favorable location in the cell's genome for high levels of expression. Alternatively, a sufficiently high number of copies of the gene transfer polynucleotide must be present in the cell's genome, such that these factors compensate for the low levels of expression achievable because of the expression control elements. It is thus preferable for the gene transfer polynucleotide to comprise transposon ends, for example of a piggyBac-like transposon, to ensure the integration of multiple copies of the gene transfer polynucleotide in transcriptionally active regions of the cell. An advantageous polynucleotide for expression in mammalian cells comprises a gene encoding glutamine synthetase and a sequence selected from SEQ ID NO: 7-10.

5. EXAMPLES

The following examples illustrate the methods, compositions and kits disclosed herein and should not be construed as limiting in any way. Various equivalents will be apparent from the following examples; such equivalents are also contemplated to be part of the invention disclosed herein.

5.1 Selection of Advantageous RNA Export Elements 5.1.1 Functional Test of PRE Elements.

Two post-transcriptional regulatory elements (PREs) have been described from hepatitis B viral genomes, one from humans (Huang, J. and Liang, T. J., 1993. Mol. Cell Biol. 13: 7476-7486) and one from woodchuck (Donello, J. E. et. al., 1998. J. Virol. 72: 5085-5092). The sequences of these elements are shown as SEQ ID NO: 241 and 232 respectively.

We measured the effectiveness of PRE elements in enhancing gene expression using expression levels of a test antibody. Expression of this antibody is enhanced when the polynucleotide encoding the light chain is operably linked to an active PRE element. The heavy chain was encoded on a vector, with the entire sequence given as SEQ ID NO: 557. The light chain was encoded on a vector, with the sequence given as SEQ ID NO: 558. PRE and poly adenylation sequences with SEQ ID NOs shown in Table 1 column A were cloned between the XhoI and BssHII sites of SEQ ID NO: 558.

Suspension-adapted HEK 293a cells (from ATCC) were grown in Expi293 media (Thermo Fisher) at 37° C., 8% $CO_2$ to 3 million cells per ml, with shaking at 1,000 rpm (3 mm orbit). Transfections were set up in triplicates. Each transfection used 0.5 µg heavy chain DNA and 0.5 µg light chain DNA with 2.7 µl ExpiFectamine 293 transfection reagent per ml of cells, as per manufacturer's protocol. Cells were grown under the same conditions for a further 6 days before cells were removed by centrifugation, and the antibody concentration in the supernatant was measured. Concentration of antibody was measured using a ForteBio Octet with protein A tips and a purified antibody standard, according to the manufacturer's instructions. Results are shown in Table 1.

The data shown in Table 1 shows that the mean antibody titer with no PRE operably linked to the open reading frame encoding the antibody light chain was between 50 and 60 µg/ml. Inclusion of PRE elements AGS1 and AGS3 (SEQ ID NOs: 234 and 235 respectively) increased titers nearly two-fold to over 100 µg/ml. Inclusion of PRE elements HPRE (SEQ ID NOs: 240 and 241) and WPRE (SEQ ID NOs: 232 and 233) increased titers nearly four-fold to over 200 µg/ml. Thus, PRE elements are useful in improving gene expression, and the antibody system described can be used to quantify the effectiveness of PRE elements in increasing gene expression. An advantageous gene transfer vector comprises a PRE element comprising a sequence selected from SEQ ID NOs: 232-235, 240 or 241.

5.1.2 Experimental Design and Testing of Composite PRE Elements.

Two homologs of these sequences are present in the genomes of hepatitis B virus from ground squirrel and arctic ground squirrel (SEQ ID NO: 231 and 230 respectively). The structure of the woodchuck sequence (WPRE) has been dissected into three PRE sub-elements. The gamma sub-element is located within the woodchuck hepatitis virus sequence between bases 1093 and 1250 (SEQ ID NO: 300), the alpha sub-element is between bases 1300 and 1507 (SEQ ID NO: 304) and the beta sub-element is between bases 1508 and 1684 (SEQ ID NO: 311) (Donello, J. E. et. al., 1998. J. Virol. 72: 5085-5092).

The sequences of the corresponding sub-elements from human, arctic ground squirrel and ground squirrel hepatitis B viral genomes were identified by sequence identity. The ends were adjusted to lie at regions of sequence identity between the four full-length PRE sequences and BsaI, BbsI, BsmBI and SapI sites were eliminated. The SEQ ID NOs of each of these PRE sub-elements are shown in Table 2.

Five sequence element groups were identified. These were alpha, beta, gamma and delta PRE sub-elements, and a polyadenylation element. For each construct one sequence element from each sequence element group was selected. Alpha, beta, gamma and delta sequences were each chosen from the hepatitis B viruses from arctic ground squirrel (A), ground squirrel (G), humans (H) or woodchuck (W). PolyA sequences were selected from HSVTK (SEQ ID NO: 225) or rabbit beta globin (SEQ ID NO: 212). The combinations of twenty-four chimeric PRE elements (SEQ ID NOs: 242-265) with two different polyA elements were created using a Design of Experiment algorithm (Fedorov exchange algorithm for D-optimal experimental designs). The compositions and SEQ ID NOs of these chimeric PRE elements are shown in Table 3.

The chimeric PRE elements were tested using the antibody expression system described in Section 5.1.1. PRE and poly adenylation sequences with SEQ ID NOs shown in Table 3 columns F and G were cloned between the XhoI and BssHII sites of SEQ ID NO: 558. Suspension-adapted HEK 293a cells (from ATCC) were grown in Expi293 media (Thermo Fisher) at 37° C., 8% $CO_2$ to 3 million cells per ml, with shaking at 1,000 rpm (3 mm orbit). Transfections were set up in triplicates. Each transfection used 0.5 μg heavy chain DNA and 0.5 μg light chain DNA with 2.7 μl Expi-Fectamine 293 transfection reagent per ml of cells, as per manufacturer's protocol. Cells were grown under the same conditions for a further 6 days before cells were removed by centrifugation, and the antibody concentration in the supernatant was measured. Concentration of antibody was measured using a ForteBio Octet with protein A tips and a purified antibody standard, according to the manufacturer's instructions. Antibody titers from 3 independent transfections shown in Table 3 columns H-J. Table 3 shows that incorporation of different chimeric PRE elements into an expression construct can be used to modulate the expression of an operably linked open reading frame. An advantageous gene transfer vector comprises a sequence a PRE element comprising a sequence selected from SEQ ID NOs: 242-265.

The antibody titers produced by the 24 element combinations were used to generate a partial least squares regression model as described in Section 4.2.2 and shown in Equation 3:

$$Y = w_1 x_1 + w_2 x_2 + \ldots w_i x_i \quad \text{(Eq. 3)}$$

Where Y is the antibody titer produced, $x_i$ is a descriptor of the sequence (for example the presence or absence of each of the 19 different possible sequence elements), and $w_i$ is a weight (or coefficient) of $x_i$.

The model was created 1,000 times, each time by leaving out 10% of the sequences selected at random. The results of the modelling are shown in Table 4. Here the element group is shown in column A, the source for the element in that group is shown in column B: arctic ground squirrel (A), ground squirrel (G), human (H) and woodchuck (W). The average model weight for each element from 1,000 models is shown in column C. More positive numbers reflect a greater positive contribution to antibody expression, more negative numbers reflect a more negative effect of that element on expression.

5.1.3 A Second Round of Experimental Design and Testing of Composite PRE Elements.

The PRE element from woodchuck hepatitis B virus has been shown to encode an X protein, which has been implicated in the generation of liver cancers. It is thus desirable to prevent expression of the X protein within PRE elements, especially when the PRE element may be a part of a genetic construct that is used within a patient. The promoter for the X protein is at the end of the alpha sub-element, and part of the coding region for the X protein is in the beta sub-element. We therefore performed a second optimization of PRE sub-elements, which involved finding the best combinations based on the model from the previous round (described in Section 5.1.2), and exploring X– versions of the alpha and beta sub-elements.

The model weights shown in Table 4 indicate that for expression of the antibody used to test these elements, the most advantageous delta PRE elements were either no delta element, or the element from human (SEQ ID NO: 295); the most advantageous gamma PRE elements were those from human (SEQ ID NO: 299) or woodchuck (SEQ ID NO: 300); the most advantageous alpha PRE elements were those from woodchuck (SEQ ID NO: 304) or arctic ground squirrel (SEQ ID NO: 301) and the most advantageous beta PRE elements were those from human (SEQ ID NO: 310) or arctic ground squirrel (SEQ ID NO: 308).

In addition to these elements we designed X– versions of the alpha sub-element sequences by altering sequences around the promoter and eliminating the initiating AUG for the woodchuck, human and arctic ground squirrel alpha sub-elements (SEQ ID NOs: 305, 307 and 306 respectively). We also designed a longer version of the woodchuck beta sub-element (SEQ ID NO: 312), an X– version of this (SEQ ID NO: 313), a long X– version of the arctic ground squirrel beta sub-element (SEQ ID NO: 314), and an X– version of the human beta sub-element (SEQ ID NO: 315). Thus, an advantageous polynucleotide for expression comprises a PRE element comprising a sequence selected from SEQ ID NO: 295, 299-301, 304-308, 310 or 312-316 operably linked to a heterologous open reading frame or a heterologous promoter.

A second set of 24 PRE sub-element combinations (SEQ ID NOs: 266-292) were designed using a Design of Experiment algorithm (Fedorov exchange algorithm for D-optimal experimental designs). The compositions and SEQ ID NOs of these chimeric PRE elements are shown in Table 5.

The chimeric PRE elements were tested using the antibody expression system described in Section 5.1.1. PRE sequences with SEQ ID NOs shown in Table 5 column F and polyadenylation sequence SEQ ID NO: 212 were cloned between the XhoI and BssHII sites of SEQ ID NO: 558. Suspension-adapted HEK 293a cells (from ATCC) were grown in Expi293 media (Thermo Fisher) at 37° C., 8% $CO_2$ to 3 million cells per ml, with shaking at 1,000 rpm (3 mm orbit). Transfections were set up in triplicates. Each transfection used 0.5 μg heavy chain DNA and 0.5 μg light chain DNA with 2.7 μl ExpiFectamine 293 transfection reagent per ml of cells, as per manufacturer's protocol. Cells were grown under the same conditions for a further 6 days before cells were removed by centrifugation, and the antibody concentration in the supernatant was measured. Concentration of antibody was measured using a ForteBio Octet with protein A tips and a purified antibody standard, according to the manufacturer's instructions. Antibody titers from 3 independent transfections are shown in Table 5 columns G-I. All composite PRE elements used enhanced antibody expression. Thus, an advantageous polynucleotide for expression comprises a sequence selected from SEQ ID NOs: 266-289 operably linked to a heterologous open reading frame or RNA-encoding sequence or a heterologous promoter and is an aspect of the invention.

The antibody titers produced by the 24 element combinations were used to generate a partial least squares regression model as described in Section 5.1.2. Model weights are shown in Table 6. The model weights predict that the most advantageous combinations of PRE sub-elements for maximal antibody expression are: delta, no sub-element; gamma, WPRE (SEQ ID NO: 300); alpha, HPRE (X−) (SEQ ID NO: 307) or WPRE (X−) (SEQ ID NO: 303) or WPRE (SEQ ID NO: 304); beta WPRE long (X−) (SEQ ID NO: 313). Thus, an advantageous polynucleotide for expression comprises a sequence selected from SEQ ID NO: 300, SEQ ID NO: 307, SEQ ID NO: 303, SEQ ID NO: 304 or SEQ ID NO: 313 operably linked to a heterologous open reading frame or RNA-encoding sequence or a heterologous promoter. Particularly advantageous composite PRE sub-elements are SEQ ID NOs: 288 and 290-292, of which SEQ ID NOs: 290-292 are also disabled for expression of the X protein. Thus, an advantageous polynucleotide for expression comprises a sequence selected from SEQ ID NO: 288 or 290-292, operably linked to a heterologous open reading frame or RNA-encoding sequence or to a heterologous promoter.

The model weights from the first round, shown in Table 4, show that the woodchuck beta sub-element (SEQ ID NO: 311) has a slightly negative weight. The model weights from the second round, shown in Table 6, show that all of the beta sub-elements are advantageous over no beta sub-element. However, the most advantageous beta sub-element is the WPRE long (X−) (SEQ ID NO: 313). This sequence comprises additional sequences from WPRE beyond the sequences between bases 900-1800 which were previously known to enhance expression of an operably linked open reading frame (Donello, J. E. et. al., 1998. J. Virol. 72: 5085-5092). The additional sequences shown herein to enhance gene expression are given as SEQ ID NO: 316. Thus, an advantageous polynucleotide for expression comprises a sequence selected from SEQ ID NO: 313 or 316 operably linked to a heterologous open reading frame or RNA-encoding sequence or to a heterologous promoter.

5.2 Advantageous RNA Export Elements in Cho Cells 5.2.1 Use of PRE Elements to Control Relative Expression of Different Genes.

As described in Section 4.2.3, it is often useful to be able to encode more than one gene on a single polynucleotide and adjust the relative expression levels of these genes. PRE elements offer a precisely targeted means of manipulating expression of individual genes relatively independently, because the effects should be limited to just the transcript in which they occur. A transcriptional unit comprising a PRE element should be differentially exported from the cell nucleus relative to a transcriptional unit that does not comprise a PRE element.

Two pairs of transposons were designed to demonstrate the effect of PRE elements in multi-gene constructs. The sequences of the transposons are given as SEQ ID NOs: 560-563. These transposons comprise genes encoding DasherGFP and CayenneRFP. They all also comprise a functional glutamine synthetase gene. In all 4 transposons, Dasher GFP is operably linked to a human EF1 promoter and intron, and to the human CMV poly adenylation signal sequence. In transposons with SEQ ID Nos: 560 and 561, CayenneRFP is operably linked to murine CMV enhancer and promoter and a murine EF1a intron. In transposons with SEQ ID Nos: 562 and 563, CayenneRFP is operably linked to human CMV enhancer, murine CMV promoter and a murine EF1a intron. The DasherGFP transcript in transposons SEQ ID NOs: 561 and 563 comprises PRE with SEQ ID NO: 240 after the DasherGFP open reading frame, while in transposons with SEQ ID NOs: 560 and 562 the DasherGFP transcript does not comprise a PRE.

CHO-K1 GS KO cells (from Horizon Discovery) were grown according to the manufacturer's recommendations at 37° C., 5% $CO_2$ to between 1 and 2 million cells per ml. Cells (2,500,000) were electroporated (using the Neon transfection system from ThermoFisher) with 30 μg transposons DNA and 3 μg mRNA encoding transposase SEQ ID NO: 568. After 48 hours, cells were transferred into media lacking glutamine, and grown until glutamine-expressing cells recovered. Cells were grown for 14 days post selection with two passages and changes of media. Aliquots of cells were harvested, diluted to an $A_{600}$ of 0.3, and measured in a fluorimetric plate reader. DasherGFP fluorescence was measured at Ex/Em of 488/518 nm and CayenneRFP was measured at Ex/Em of 525/580 nm. Mean fluorescence from triplicate independent measurements are shown in Table 7 columns B and C respectively.

CayenneRFP fluoresces with approximately a 2.5-fold lower intensity than DasherGFP. Thus, to convert fluorescence intensities to relative expression levels, the CayenneRFP fluorescence needs to be multiplied by 2.5. Column D in Table 7 shows the CayenneRFP fluorescence adjusted in this way, so that the fluorescence numbers for both proteins indicate the relative expression levels of the two proteins. Column E shows the relative expression of GFP and RFP.

Table 7 shows that the GFP/RFP ratio increases by a factor of 2.1 from the transposon with SEQ ID NO: 560 to SEQ ID NO: 561 (from 0.86 to 1.81). DasherGFP expression increases 1.9-fold (from 11,699 to 21,951), while CayenneRFP expression decreases by a small factor of 0.9 (from 13,662 to 12,129). Similarly, the GFP/RFP ratio increases by a factor of 2.8 from the transposon with SEQ ID NO: 562 to SEQ ID NO: 563 (from 0.35 to 0.99). DasherGFP expression increases 2.5-fold (from 6,339 to 15,548), while CayenneRFP expression again decreases by only a small factor of 0.9 (from 18,123 to 15,738). Table 7 column F shows the sum of GFP and RFP expression. The total productivity of the construct with SEQ ID NO: 560 is about 1.3-fold higher than the construct with SEQ ID NO: 561 (33,991 compared with 25,303). Similarly, the total productivity of the construct with SEQ ID NO: 562 is about 1.3-fold higher than the construct with SEQ ID NO: 563 (30,603 compared with 24,442).

The data in Table 7 shows that inclusion of a PRE element between the 3' end of an open reading frame and its polyadenylation sequence can significantly increase expression of that gene, while having only minor effects on the expression of other genes on the same construct. Example 5.1 describes many different non-natural PRE elements, including SEQ ID NOs: 242-292, and shows that these different PRE elements differ in the degree to which they enhance expression. Other non-natural PRE elements may be constructed by selecting an alpha PRE sub-element selected from SEQ ID NOs 301-307, and combining it with a beta PRE sub-element selected from SEQ ID NOs 308-316. Optionally the PRE element may further comprise a gamma PRE sub-element selected from SEQ ID NOs 297-300. Optionally the PRE element may further comprise a delta PRE sub-element selected from SEQ ID NOs 293-296. The non-natural PRE elements described herein may be incorporated into a polynucleotide encoding two or more genes in order to modulate the relative expression of those two or more genes. Because of the range of expression-enhancing activities of these non-natural PRE elements, PRE elements may be used to fine-tune the relative expression of two or three or four or more polypeptides. In some embodiments of the invention, a polynucleotide for the expression of two or more polypeptides comprises a non-natural PRE element. In some embodiments of the invention, a polynucleotide for the expression of two or more polypeptides comprises two different PRE elements, each operably linked to a different open reading frame or RNA-encoding sequence or a different promoter. In some embodiments of the invention, one of the PRE elements comprises a sequence selected from SEQ ID NO: 242-292 operably linked to an open reading frame or RNA-encoding sequence or a promoter. In some embodiments of the invention, one of the PRE elements is a non-naturally occurring sequence comprising a sequence selected from SEQ ID NO: 293-316.

5.2.2 Use of Chimeric PRE Elements to Control Relative Expression of Different Genes.

As described in Section 4.2.3, it is often useful to be able to encode more than one gene on a single polynucleotide and adjust the relative expression levels of these genes. Table 3 shows that incorporation of different chimeric PRE elements into the transcript to the 3' of an antibody light chain gene led to different levels of expression of the antibody in HEK cells. We selected 5 PRE elements from this set; ranked from most positive to least positive effect on antibody expression they were chimeric PRE numbers 20, 8, 22, 11 and 21 from Table 3 (SEQ ID NOs: 261, 249, 263, 252 and 262).

These PREs were tested for their effect on the relative expression of two open reading frames. The two open reading frames were epitope-tagged versions of an antibody light chain. The first ORF (ORF1) comprised a V5 epitope tag and had amino acid sequence SEQ ID NO: 569, encoded by DNA sequence SEQ ID NO: 570. The second ORF (ORF2) comprised a FLAG epitope tag and had amino acid sequence SEQ ID NO: 571, encoded by DNA sequence SEQ ID NO: 572. ORF1 was immediately preceded by a polynucleotide comprising the sequence SEQ ID NO: 564, which comprised a human EF1a promoter and intron operably linked to ORF1. This sequence also encodes s a glutamine synthetase and includes regulatory elements controlling its expression. ORF2 was immediately followed by a polynucleotide comprising the sequence SEQ ID NO: 565, which comprised a PRE element (SEQ ID NO: 240) and a polyadenylation signal (SEQ ID NO: 212) operably linked to ORF2. Sequences SEQ ID NO: 564 and 565 also comprised insulator sequences and transposon ends recognized by transposase SEQ ID NO: 568, such that each construct in this example is transposable by transposase SEQ ID NO: 568 into the genome of a CHO cell.

The PREs were tested in two different regulatory element environments. In the first regulatory element environment, the two ORFs were separated by a polynucleotide whose sequence comprised SEQ ID NO: 566. In this way ORF1 was operably linked to a polyadenylation sequence from HSV-TK and ORF2 was operably linked to a rat EF1a promoter and intron. In the second regulatory element environment, the two ORFs were separated by a polynucleotide whose sequence comprised SEQ ID NO: 567. In this way ORF1 was operably linked to a polyadenylation sequence from EF1a and ORF2 was operably linked to a human CMV enhancer, a murine CMV promoter and a murine EF1a intron. Each transposon further comprised a PRE element immediately following ORF1 and preceding its polyadenylation sequence. The PRE SEQ ID NO operably linked to ORF1 in each transposon is shown in Table 8 column D. In each transposon in Table 8, ORF2 was linked to PRE element SEQ ID NO: 240.

CHO-K1 GS KO cells (from Horizon Discovery) were grown according to the manufacturer's recommendations at 37° C., 5% $CO_2$ to between 1 and 2 million cells per ml. Each transposon shown in Table was transfected into CHO cells as follows. Cells (2,500,000) were electroporated (using the Neon transfection system from ThermoFisher) with 30 μg transposon DNA and 3 μg mRNA encoding transposase SEQ ID 568. After 48 hours, cells were transferred into media lacking glutamine, and grown until glutamine-expressing cells recovered. Recovered cell pools were seeded at an initial cell density of 300,000 cells per ml into 10 ml EX-CELL Advanced CHO Fed-Batch Media in a 50 ml TPP tube. Cells were grown at 37° C., 5% $CO_2$, 200 rpm with a 50 mm orbit. Cells were supplemented with 10% v/v EX-CELL Advanced Feed 1 on days 3, 5, 7, 9 and 11, and glucose was added to 4 g/L whenever glucose levels fell below 2 g/L. Cells were removed by centrifugation on day 14 and samples of the supernatant were run on an SDS polyacrylamide gel together with known quantities of V5 and FLAG-tagged standards, blotted to nitrocellulose and probed with antibodies against the V5 and FLAG epitope tags. These Western blot signals from the supernatant samples were compared with the standards to quantify the amount of each ORF produced in each case. Data is shown in Table 8.

The expression of ORF1 relative to ORF2 is shown in Table 8 column G. Higher levels of ORF1/ORF2 indicate a more positive effect of the PRE on expression of ORF1; lower levels of ORF1/ORF2 indicate a less positive effect of the PRE on expression of ORF1. For four of the five chimeric PREs, the rank order of effect was the same as observed in HEK cells (see Section 5.1.2 and Table 3): PRE numbers (from Table 3) 8>22>11>21. The exception was PRE number 20, which had a strong effect in HEK cells, but a weaker and less predictable effect in CHO cells. The effect of the PRE was primarily on the expression of ORF1, ORF2 expression remained approximately constant. The coefficient of variation (CV) of ORF2 expression was 0.08 for transposons comprising SEQ ID NO: 566, and 0.06 for transposons comprising SEQ ID NO: 567. In contrast the CV of ORF1 expression was 0.18 for transposons comprising SEQ ID NO: 566, and 0.27 for transposons comprising SEQ ID NO: 567. Table 8 also shows that, in addition to chimeric PRE elements, other PRE elements, including natural and non-natural PRE elements such as SEQ ID NOs: 237, 240 and 238 can modulate the expression of one gene relative to a second gene.

The data shown in Table 8 demonstrates that PRE elements offer a means of manipulating the expression of individual genes without affecting the expression of other genes expressed from the same polynucleotide. An advantageous polynucleotide for the expression of two or more polypeptides comprises two different PRE elements, each one operably linked to a heterologous promoter or a heterologous open reading frame or RNA-encoding sequence. In some embodiments of the invention, one of the PRE elements comprises a sequence selected from SEQ ID NOs: 228-292. In some embodiments of the invention, one of the PRE elements comprises SEQ ID NO: 240. In some embodiments of the invention the PRE element is not a naturally occurring sequence.

5.3 Selection of Advantageous AAV Vector Configurations

5.3.1 Experimental Design of AAV Vector Configurations.

The amount of DNA that can be carried in adeno-associated virus (AAV) vectors is severely limited by the requirement for viral packaging. The total length of packaged DNA cannot exceed 4.7 kb, which leaves about 4.3 kb of available space excluding the ITRs. To maximize the available space in an AAV vector without sacrificing the ability of the vector to achieve high expression levels, we designed a set of vectors to understand the contribution of different elements to gene expression from the vector. To do this we identified a plurality of sequence element groups. As shown in Table 9 column A these groups were (1) enhancer sequences, (2) promoter sequences, (3) intron sequences, (4) RNA export element sequences, (5) 3'-UTR sequences and (6) polyadenylation signal sequences. These groups contained 3, 4, 5, 3, 2 and 4 members respectively. There are a total of 1,440 possible combinations of these elements. To design a much smaller but statistically representative set of these vectors we used a Fedorov exchange algorithm for D-optimal experimental designs to generate 60 element combinations, as shown in Table 10.

A gene for the light chain of an antibody with a C-terminal V5 epitope tag with amino acid sequence SEQ ID NO: 569 and DNA sequence SEQ ID NO: 570, was cloned into each of the 60 vector configurations shown in Table 10. These constructs were then transfected into suspension-adapted HEK 293a cells (from ATCC). Cells were grown in Expi293 media (Thermo Fisher) at 37° C., 8% $CO_2$ to 3 million cells per ml, with shaking at 1,000 rpm (3 mm orbit). Transfections were set up in triplicates. Each transfection used 1 µg DNA with 2.7 µl ExpiFectamine 293 transfection reagent per ml of cells, as per manufacturer's protocol. Cells were grown under the same conditions for a further 6 days before cells were removed by centrifugation, and the antibody concentration in the supernatant was measured. Concentration of antibody was measured using a ForteBio Octet with protein A tips and a purified standard, according to the manufacturer's instructions. Results are shown in Table 10 column J. Particularly advantageous AAV vectors comprise a sequence selected from SEQ ID NOs: 323-327, 329, 335-339, 341, 349-352, or 362-365 to the 5' of the open reading frame or RNA-encoding sequence. Particularly advantageous AAV vectors comprise a sequence selected from SEQ ID NOs: 433-435, 437-441, 442, 444-450, or 452-455 to the 3' of the open reading frame or RNA-encoding sequence.

The same constructs were transfected into Freestyle CHO-S cells (Thermo Fisher). Cells were grown in Mirus CHOgro media at 37° C., 8% $CO_2$ to 2 million cells per ml, with shaking at 1,000 rpm (3 mm orbit). Transfections were set up in triplicates. Each transfection used 1 µg DNA with 1 µl TransIT-PRO® transfection reagent plus 0.5 µl PRO Boost reagent (both from Mirus) per ml of cells, as per manufacturer's protocol. The temperature was reduced to 32° C. at 24 hours post-transfection. Cells were grown under the same conditions for a further 5 days before cells were removed by centrifugation, and the antibody concentration in the supernatant was measured. Concentration of antibody was measured using a ForteBio Octet with protein A tips and a purified standard, according to the manufacturer's instructions. Results are shown in Table 10 column K. Particularly advantageous AAV vectors comprise a sequence selected from SEQ ID NOs: 323-329, 332-334, 336, 339, 342, 344, 347, 355, or 362-365 to the 5' of the open reading frame or RNA-encoding sequence. Particularly advantageous AAV vectors comprise a sequence selected from SEQ ID NOs: 433, 435, 437, 438, 440, 441, 443-447, 449, 450, 452, 453 or 456 to the 3' of the open reading frame or RNA-encoding sequence.

The same constructs were transfected into ExpiCHO cells (Thermo Fisher). Cells were grown in ExpiCHO media at 37° C., 8% $CO_2$ to 6 million cells per ml, with shaking at 240 rpm (25 mm orbit). Each transfection used 10 ml of cells and 0.8 µg DNA with 0.8 µl ExpiFectamine transfection reagent per ml of cells, as per manufacturer's protocol. The temperature was reduced to 32° C. at 24 hours post-transfection. Cells were grown under the same conditions for a further 5 days before cells were removed by centrifugation, and the antibody concentration in the supernatant was measured. Concentration of antibody was measured using a ForteBio Octet with protein A tips and a purified standard, according to the manufacturer's instructions. Results are shown in Table 10 column L. Particularly advantageous AAV vectors comprise a sequence selected from SEQ ID NOs: 324, 328, 329, 333, 336, 338-342, 349, 351, 354, or 362-365 to the 5' of the open reading frame. Particularly advantageous AAV vectors comprise a sequence selected from SEQ ID NOs: 435, 439-441, 444, 446-449 or 451-456 to the 3' of the open reading frame or RNA-encoding sequence.

5.3.2 Identification of Advantageous AAV Vector Elements.

The expression data shown in Table 10 was used to generate partial least squares regression models for HEK, CHO-S and ExpiCHO as described in Section 4.2.2 and shown in Equation 3:

$$Y = w_1 x_1 + w_2 x_2 + \ldots w_i x_i \qquad \text{(Eq. 3)}$$

Where Y is the expression level, $x_i$ is a descriptor of the sequence (for example the presence or absence of each of the 21 different possible sequence elements), and $w_i$ is a weight (or coefficient) of $x_i$.

Each model was created 1,000 times, each time by leaving out 10% of the sequences selected at random. The results of the modelling are shown in Table 11. Here the element group is shown in column A, the element name is shown in column B, the element SEQ ID NO is shown in column C. The average model weight for each element from 1,000 models for HEK is shown in column D, for CHO in column F, and for expiCHO in column H. More positive numbers reflect a greater positive contribution to expression, more negative numbers reflect a more negative effect of that element on expression.

The most positive model weights for expression in HEK indicate the sequence elements that are most advantageous in an AAV-based expression vector for HEK cells. These are the human CMV enhancer (e.g. SEQ ID NO: 11, or a sequence at least 95% identical to a sequence selected from SEQ ID NO: 11-20), the human CMV promoter (e.g. SEQ ID NO: 52, or a sequence selected from SEQ ID NOs: 48-52) and the MLP intron (e.g. SEQ ID NO: 139 or a sequence at least 95% identical to a sequence selected from SEQ ID NO: 139-140). Other elements that are advantageous in an AAV-based expression vector for HEK cells include the HPRE (e.g. SEQ ID NO: 240) and WPRE (e.g. SEQ ID NO: 233) RNA export elements, the SV40 (e.g. SEQ ID NO: 227 or a sequence at least 95% identical to a sequence selected from SEQ ID NO: 220-223 or 227) and bovine growth hormone (e.g. SEQ ID NO: 206 or a sequence at least 95% identical to a sequence selected from SEQ ID NOs: 205-207) polyadenylation sequences, the murine CMV enhancer (e.g. SEQ ID NO: 24 or a sequence at least 95% identical to a sequence selected from SEQ ID NOs:

21-25) and the human globin 3' UTR (e.g. SEQ ID NO: 579). Polynucleotides comprising one or more of these sequence elements operably linked to a heterologous open reading frame or RNA-encoding sequence are advantageous for expression in HEK cells and other comparable cell types including human cells and kidney cells.

The most positive model weights for expression in CHO-S indicate the sequence elements that are most advantageous in an AAV-based expression vector for CHO cells. These are the murine CMV promoter (e.g. SEQ ID NO: 54 or a sequence at least 95% identical to a sequence selected from SEQ ID NOs: 53-56), the human CMV intron c (e.g. SEQ ID NO:97 or a sequence at least 95% identical to a sequence selected from SEQ ID NOs: 97, 102 or 103), the murine CMV enhancer (e.g. SEQ ID NO: 24 or a sequence at least 95% identical to a sequence selected from SEQ ID NOs: 21-25) and the human CMV enhancer (e.g. SEQ ID NO: 11, or a sequence at least 95% identical to a sequence selected from SEQ ID NO: 11-20). Other elements that are advantageous in an AAV-based expression vector for CHO cells include the HPRE (e.g. SEQ ID NO: 240) RNA export element, the SV40 (e.g. SEQ ID NO: 227 or a sequence at least 95% identical to a sequence selected from SEQ ID NO: 220-223 or 227) and bovine growth hormone (e.g. SEQ ID NO: 206 or a sequence at least 95% identical to a sequence selected from SEQ ID NOs: 205-207) polyadenylation sequences, the murine EF1 intron (e.g. SEQ ID NO: 111) and the human globin 3' UTR (e.g. SEQ ID NO: 579). Polynucleotides comprising one or more of these sequence elements operably linked to a heterologous open reading frame or RNA-encoding sequence are advantageous for expression in CHO cells and other comparable cell types including rodent cells and are an aspect of the invention.

The most positive model weights for expression in ExpiCHO indicate the sequence elements that are most advantageous in an AAV-based expression vector for ExpiCHO cells. These are the murine CMV promoter (e.g. SEQ ID NO: 54 or a sequence at least 95% identical to a sequence selected from SEQ ID NOs: 53-56) and the human globin 3' UTR (e.g. SEQ ID NO: 579). Other elements that are advantageous in an AAV-based expression vector for ExpiCHO cells include the murine CMV enhancer (e.g. SEQ ID NO: 24 or a sequence at least 95% identical to a sequence selected from SEQ ID NOs: 21-25), the human CMV enhancer (e.g. SEQ ID NO: 11, or a sequence at least 95% identical to a sequence selected from SEQ ID NO: 11-20), the MLP intron (e.g. SEQ ID NO: 139 or a sequence at least 95% identical to a sequence selected from SEQ ID NO: 139-140) and the beta globin (e.g. SEQ ID NO: 214 or a sequence at least 95% identical to a sequence selected from SEQ ID NO: 212-216) and bovine growth hormone (e.g. SEQ ID NO: 206 or a sequence at least 95% identical to a sequence selected from SEQ ID NOs: 205-207) polyadenylation sequences. Polynucleotides comprising one or more of these sequence elements operably linked to a heterologous open reading frame or RNA-encoding sequence are advantageous for expression in ExpiCHO cells and other comparable cell types including rodent cells, such polynucleotides are an aspect of the invention.

5.4 Advantageous Enhancer, Promoter and Intron Elements

5.4.1 Sequence Elements from Simian Viruses.

We identified putative enhancer (SEQ ID NO: 26), promoter (SEQ ID NO: 58) and intron sequences (SEQ ID NOs: 99, 101 and 105) from a chimpanzee virus. To determine whether the elements were functional various combinations of elements were cloned between the BsaI sites of a vector with sequence SEQ ID NO: 559. This operably linked the promoter and intron to open reading frames encoding the light and heavy chains of an antibody linked by an IRES.

Suspension-adapted HEK 293a cells (from ATCC) were grown in Expi293 media (Thermo Fisher) at 37° C., 8% $CO_2$ to 3 million cells per ml, with shaking at 1,000 rpm (3 mm orbit). Transfections were set up in triplicates. Each transfection used 1 μg DNA with 2.7 μl ExpiFectamine 293 transfection reagent per ml of cells, as per manufacturer's protocol. Cells were grown under the same conditions for a further 6 days before cells were removed by centrifugation, and the antibody concentration in the supernatant was measured. Concentration of antibody was measured using a ForteBio Octet with protein A tips and a purified antibody standard, according to the manufacturer's instructions. Results are shown in Table 12.

All of the regulatory element combinations tested showed high productivity (>500 μg/ml). The highest productivity was obtained from combinations SEQ ID NOs: 148-152. The introns in these constructs are non-natural hybrid introns with a modified acceptor sequence. SEQ ID NO: 102 is a modified version of human CMV intron C, SEQ ID NO: 104 is a modified version of human CMV intron A. A comparably high productivity was also obtained from combination SEQ ID NO: 153. This combination comprises an enhancer with sequence SEQ ID NO: 26, a promoter with sequence SEQ ID NO: 58, and an intron with sequence SEQ ID NO: 105. SEQ ID NO: 105 is a version of the chimpanzee virus intron A with a modified acceptor sequence. This intron also works well in the context of the human CMV enhancer and promoter (Table 12 row 7). A second chimpanzee CMV intron, SEQ ID NO: 99, also worked well in the context of human or chimpanzee viral promoters (Table 12 rows 9 and 10). A mouse CMV intron, SEQ ID NO: 100, also worked well in the context of human viral promoters (Table 12 row 11).

An advantageous polynucleotide for expression of genes in mammalian cells comprises an intron sequence with at least 95% sequence identity to SEQ ID NO: 96-105 operably linked to a heterologous open reading frame or RNA-encoding sequence. An advantageous polynucleotide for expression of genes in mammalian cells comprises an enhancer sequence with at least 95% sequence identity to SEQ ID NO: 26, operably linked to a heterologous open reading frame or RNA-encoding sequence. An advantageous polynucleotide for expression of genes in mammalian cells comprises a sequence with SEQ ID NO: 58 operably linked to a heterologous open reading frame or RNA-encoding sequence. An advantageous polynucleotide for expression of genes in mammalian cells comprises a sequence with at least 95% sequence identity to SEQ ID NO: 142-158 operably linked to a heterologous open reading frame or RNA-encoding sequence.

5.4.2 Sequence Elements for ExpiCHO.

Example 5.3 showed that different sequence elements are advantageous in different expression systems. ExpiCHO is a cell line that can grow to high densities, thereby yielding high expression or heterologous proteins. We examined the expression of an antibody in ExpiCHO when controlled by 33 different combinations of control elements. The combinations of control elements are shown in Table 9.

The constructs were transfected into ExpiCHO cells (Thermo Fisher). Cells were grown in ExpiCHO media at 37° C., 8% $CO_2$ to 6 million cells per ml, with shaking at 240 rpm (25 mm orbit). Each transfection used 10 ml of cells and 0.8 μg DNA with 0.8 μl ExpiFectamine transfection reagent per ml of cells, as per manufacturer's protocol. The temperature was reduced to 32° C. at 24 hours post-transfection. Cells were grown under the same conditions for a further 5 days before cells were removed by centrifugation, and the antibody concentration in the supernatant was measured. Concentration of antibody was measured using a ForteBio Octet with protein A tips and a purified standard, according to the manufacturer's instructions. As shown in Table 13, all combinations of regulatory elements used were effective at producing antibody from ExpiCHO cells. An advantageous polynucleotide for expression of a gene in a mammalian cell comprises a sequence selected from SEQ ID NO: 158-191. An advantageous polynucleotide for expression of a gene in a mammalian cell comprises a viral amplifier sequence selected from SEQ ID NO: 581-584.

The expression data shown in Table 13 was used to generate partial least squares regression models for ExpiCHO as described in Section 4.2.2 and shown in Equation 3:

$$Y = w_1 x_1 + w_2 x_2 + \ldots w_i x_i \quad \text{(Eq. 3)}$$

Where Y is the expression level, $x_i$ is a descriptor of the sequence (for example the presence or absence of each of the possible sequence elements), and $w_i$ is a weight (or coefficient) of $x_i$.

Each model was created 1,000 times, each time by leaving out 10% of the sequences selected at random. The results of the modelling are shown in Table 14. Here the element group is shown in column A, the element name is shown in column B. The average model weight for each element from 1,000 models is shown in column C. More positive numbers reflect a greater positive contribution to expression, more negative numbers reflect a more negative effect of that element on expression.

Particularly advantageous enhancer elements for expression in CHO are those from murine CMV, such as a sequenced selected from SEQ ID NOs: 21-24. Enhancer elements SEQ ID NO: 22-24 share a 102 nucleotide sequence (SEQ ID NO: 25). The data in Table 13 rows 29-32 shows that the murine CMV enhancer can be operably linked to a heterologous promoter including an actin promoter or a GAPDH promoter. An advantageous polynucleotide for expression of a gene comprises SEQ ID NO: 25 operably linked to a heterologous promoter, including a promoter comprising a sequence selected from SEQ ID NO: 29-52 or 57-78. Particularly advantageous promoter elements for expression in CHO are those from rodent genes including actin from mouse (e.g. a sequence selected from SEQ ID NOs: 72 or 73), actin from hamster (e.g. SEQ ID NO: 71), GAPDH from mouse (e.g. SEQ ID NO: 78) and the promoter from murine CMV (e.g. a sequence selected from SEQ ID NO: 53-57). Rodent actin promoter sequences share a 61 nucleotide sequence (SEQ ID NO: 76) that includes a TATA box. An advantageous polynucleotide for expression of a gene in a mammalian cell comprises SEQ ID NO: 76 operably linked to a heterologous open reading frame or RNA-encoding sequence; an advantageous polynucleotide for expression of a gene in a mammalian cell comprises a sequence selected from SEQ ID NOs: 71-75. Particularly advantageous intron elements for expression of a gene in CHO are those from actin genes including actin from mouse (e.g. a sequence selected from SEQ ID NOs: 128, 129 or 133), actin from hamster (e.g. a sequence selected from SEQ ID NOs: 126, 127 or 132) and the intron from GAPDH from mouse (e.g. SEQ ID NO: 138). An advantageous polynucleotide for expression of a gene in a mammalian cell comprises an intron comprising a sequence at least 95% identical to a sequence selected from SEQ ID NO: 99-105 or 126-138, operably linked to a heterologous open reading frame or RNA-encoding sequence. An advantageous polynucleotide for expression of a gene comprises SEQ ID NO: 25 operably linked to a heterologous intron, for example an intron comprising a sequence that is at least 95% identical to a sequence selected from SEQ ID NO: 91-140. Particularly advantageous combinations of enhancer, promoter and intron elements for expression in CHO include SEQ ID NOs: 159, 161, 164, 170, 172, 178 and 187-191. An advantageous polynucleotide for expression of a gene in CHO comprises a sequence that is at least 95% identical to a sequence selected from SEQ ID NOs: 159, 161, 164, 170, 172, 178 or 187-191 operably linked to a heterologous gene. An advantageous polynucleotide for expression of a gene in ExpiCHO cells preferably comprises a sequence selected from SEQ ID NOs: 71-73, 78 or 53-56 operably linked to a heterologous open reading frame or RNA-encoding sequence. An advantageous polynucleotide for expression in CHO cells preferably comprises a sequence that is at least 95% identical to a sequence selected from SEQ ID NOs: 126-130, 132-134 or 138 operably linked to a heterologous open reading frame or RNA-encoding sequence.

5.5 Advantageous Glutamine Synthetase Sequences

Five transposons were transfected into CHO cells lacking endogenous genes for glutamine synthetase. Transposons (25 μg) comprising genes encoding the heavy and light chains of an antibody (SEQ ID NOs: 574-578) were co-transfected with 3 μg mRNA encoding a *Xenopus* transposase fused to a heterologous nuclear localization signal (SEQ ID NO: 568). Transposon and transposase nucleic acids were electroporated into 5,000,000 suspension-adapted GS null CHO cells. Cells were grown for 48 hours post-transfection and then transferred to media lacking glutamine. Cells expressing sufficient glutamine synthetase for survival were grown out and used to start 10 ml fed batch production in 10 ml TPPs. Antibody titers and specific productivities of the pools are shown in Table 15.

The five transposons differed only in the glutamine synthetase genes and regulatory elements operably linked to the glutamine synthetase genes. As shown in Table 15, all five glutamine synthetase configurations resulted in highly productive CHO pools, with titers exceeding 1,500 μg/L. Thus, advantageous gene transfer systems comprise a polynucleotide encoding a glutamine synthetase selected from one of SEQ ID NO: 503-506. In some advantageous gene transfer systems, the glutamine synthetase gene is encoded by a sequence selected from SEQ ID NO: 509-512. In some advantageous gene transfer systems, the glutamine synthetase gene and its operably linked regulatory elements comprise a sequence selected from SEQ ID NOs: 529, 531-533 or 539.

6. BRIEF DESCRIPTION OF TABLES

Table 1. Effect of PRE Elements on Antibody Expression.

Thirteen different PRE and polyadenylation (polyA) sequence combinations were cloned following an antibody light chain as described in Section 5.1.1. SEQ ID NOs of the combined elements are given in column A. The name of each PRE element is given in column B, and the SEQ ID NOs of each PRE element is given in column C. The name of each polyA element is given in column D and the SEQ ID NOs of the polyA sequences are given in column E. Constructs were co-transfected into HEK293 cells with heavy chain construct SEQ ID NO: 557, and antibody titers measured 6 days later. Each construct combination was transfected three times, the three independent titer measurements are shown in columns F, G and H, with the average titer shown in column I.

Table 2. SEQ ID NOs of PRE Sub-Elements.

Delta, gamma, alpha and beta elements of post-transcriptional regulatory elements from hepatitis B viruses from arctic ground squirrel (A), ground squirrel (G), humans (H) and woodchuck (W) were identified as described in Section 5.1.1. This table shows the SEQ ID NOs of each element. Row 1 shows elements from arctic ground squirrel (A), row 2 shows elements from ground squirrel (G), row 3 shows elements from human (H) and row 4 shows elements from woodchuck (W) viruses. Column B shows the SEQ ID Nos of delta elements, column C shows the SEQ ID Nos of gamma elements, column D shows the SEQ ID Nos of alpha elements and column E shows the SEQ ID Nos of beta elements.

Table 3. DoE Design of New Composite PRE Elements.

Twenty-four chimeric PRE sequences were created by combining delta, gamma, alpha and beta elements of post-transcriptional regulatory elements from hepatitis B viruses from arctic ground squirrel (A), ground squirrel (G), humans (H) and woodchuck (W) as described in Section 5.1.2. For each chimera (number shown in column A), column B shows the delta element, column C shows the gamma element, column D shows the alpha element and column E shows the beta element. The SEQ ID NO of each chimera is shown in column F. This sequence was combined with a polyA sequence whose SEQ ID NO is shown in column G. The PRE and polyadenylation sequences were cloned between the XhoI and BssHII sites of SEQ ID NO: 558. Antibody was expressed as described in Section 5.1.2. Concentration of antibody was measured using a ForteBio Octet with protein A tips and a purified antibody standard, according to the manufacturer's instructions. Antibody titers from 3 independent transfections shown in columns H-J. The average antibody titer is shown in column K.

Table 4. Mathematical Model Assessment of Contribution of PRE Sub-Elements to Enhancement of Expression.

A model was constructed analyzing the contribution to expression enhancement of a total of 19 sequence elements from 5 different groups. The element group is shown in column A, the source for the element in that group is shown in column B: arctic ground squirrel (A), ground squirrel (G), human (H) and woodchuck (W). The SEQ ID NO of the sequence element is shown column C, the average model weight for each element from 1,000 models is shown in column D, and the standard deviation of that model weight is shown in column E.

Table 5. DoE Design of a Second Set of Composite PRE Elements.

Twenty-four chimeric PRE sequences were designed by combining delta, gamma, alpha and beta elements of post-transcriptional regulatory elements from hepatitis B viruses from arctic ground squirrel (A), ground squirrel (G), humans (H) and woodchuck (W) as described in Section 5.1.3. For each chimera (number shown in column A), column B shows the delta element, column C shows the gamma element, column D shows the alpha element and column E shows the beta element. The SEQ ID NO of the chimera is shown in column F. This sequence was combined with a polyA sequence SEQ ID NO 212. The PRE and polyadenylation sequences were cloned between the XhoI and BssHII sites of SEQ ID NO: 558. Antibody was expressed as described in Section 5.1.3. Concentration of antibody was measured using a ForteBio Octet with protein A tips and a purified antibody standard, according to the manufacturer's instructions. Antibody titers from 3 independent transfections shown in columns G-I.

Table 6. Mathematical Model Assessment of Contribution of PRE Sub-Elements to Enhancement of Expression.

A model was constructed analyzing the contribution to expression enhancement of a total of 18 sequence elements from 4 different groups. The element group is shown in column A, the source for the element in that group is shown in column B: viruses from arctic ground squirrel (A), ground squirrel (G), human (H) and woodchuck (W). The SEQ ID NO of the sequence element is shown column C, the average model weight for each element from 1,000 models is shown in column D, and the standard deviation of that model weight is shown in column E.

Table 7. PRE Elements in Transposons.

Transposons with SEQ ID NOs shown in column A, each comprising a gene encoding CayenneRFP and a gene encoding DasherGFP, were transfected into cells as described in Section 5.2. DasherGFP fluorescence was measured at Ex/Em of 488/518 nm (column B) and CayenneRFP was measured at Ex/Em of 525/580 nm (column C). CayenneRFP fluoresces with approximately a 2.5-fold lower intensity than DasherGFP. Thus, to convert fluorescence intensities to relative expression levels, the CayenneRFP fluorescence was be multiplied by 2.5 (column D). Column E shows the relative expression of GFP and RFP. Column F shows the combined expression of GFP and RFP.

Table 8. PRE Elements for Modulating Relative Expression of Two ORFs.

Transposons (column A) comprising two epitope-tagged ORFs were synthesized as described in Section 5.2.2. Each transposon comprised a polynucleotide comprising a polyadenylation sequence operably linked to ORF1 and a promoter and intron operably linked to ORF2. The sequence of this polynucleotide is given by the SEQ ID NO in column B. Each transposon further comprised a polynucleotide comprising a PRE sequence between the end of ORF 1 and the polynucleotide sequence from column B. The name of the PRE is shown in column C, and the sequence of this PRE is given by the SEQ ID NO in column D. Transposons were integrated into the genomes of CHO cells and expression of ORF1 and ORF2 were measured as described in Section 5.2.2. Column E shows the expression level of ORF1, column F shows the expression level of ORF2, column G shows the expression level of ORF1 relative to ORF2.

Table 9. Design Matrix for AAV Vector Configurations.

Six different sequence element classes for vectors were identified, and are shown in column A. For each of these element classes the number of members used is shown in column G. The names of each member are shown in columns B-F. "None" indicates the possibility of not including a member of this group in a functional vector. Thus, there are 3 possibilities for the enhancer element shown in this matrix: human CMV enhancer (CMV Hs), murine CMV enhancer (CMV Mm) and no enhancer (none). Abbreviations are as follows; murine CMV immediate early gene 1 (CMV Mm); human CMV immediate early gene 1 (CMV Hs); human translation elongation factor 1a (EF1 Hs); murine translation elongation factor 1a (EF1 Mm); adenoviral major late protein enhancer/intron (MLP); human CMV immediate early gene 1 third intron (CMVc); human hepatitis B virus post-transcriptional regulatory element (HPRE); woodchuck hepatitis B virus post-transcriptional regulatory element (WPRE); human alpha globin (a-globin); rabbit beta globin (b-globin); simian virus 40 (SV40); bovine growth hormone (BGH).

TABLE 10. Sixty AAV Vector Configurations.

Configurations of 60 vector configurations designed using a Design of Experiment algorithm are shown. Column A, configuration number; column B, enhancer element; column C, promoter element; column D, intron element; column E, post-transcriptional regulatory element; column F, 3' untranslated region element; column G, polyadenylation signal element. The vectors comprise the sequence whose SEQ ID NO is shown in column H to the 5' of a gene to be expressed, and the sequence whose SEQ ID NO is shown in column I to the 3' of a gene to be expressed. Abbreviations are as described for Table 9. A gene encoding the light chain of an antibody with a C-terminal V5 was cloned into each vector. The gene was expressed in HEK, CHO-S and ExpiCHO cells as described in section 5.3.1. Column J shows the average level of expression (in μg/ml) obtained from 3 independent transfections in HEK cells. Column K shows the average level of expression (in μg/ml) obtained from 3 independent transfections in CHO-S cells. Column L shows the level of expression (in μg/ml) from ExpiCHO cells.

Table 11. Mathematical Model Assessment of Contribution of Vector Elements to Expression.

Models were constructed analyzing the contribution to expression in HEK, in CHO and in ExpiCHO, of a total of 21 sequence elements from 6 different groups, using the data shown in Table 10. The element group is shown in column A. The source for the element in that group is shown in column B, abbreviations are as for Table 9. The SEQ ID NO of the sequence element is shown column C. The average model weight in HEK for each element from 1,000 models is shown in column D, and the standard deviation of that model weight is shown in column E. The average model weight in CHO for each element from 1,000 models is shown in column F, and the standard deviation of that model weight is shown in column G. The average model weight in expiCHO for each element from 1,000 models is shown in column H, and the standard deviation of that model weight is shown in column I.

Table 12. New Promoter and Enhancer Combinations.

Eleven different enhancer/promoter/intron combinations were cloned to the 5' of a bicistronic antibody gene as described in Section 5.4.1. DNA with the sequence of the SEQ ID NOs given in column B were inserted between the BsaI sites of the vector with sequence SEQ ID NO: 559. The natural host of the viruses from which the viral regulatory elements were derived are shown in columns C-E. The SEQ ID NOs of the elements are given in columns F-H. Constructs were transfected into HEK293 cells, and antibody titers measured 6 days later. Each construct combination was transfected three times, the mean titer (in μg/ml) from three independent transfections are shown in column I. Column J shows the standard deviation of the titer.

Table 13. Antibody Expression in ExpiCHO.

Genes encoding the heavy and light chain of an antibody were operably linked to an IRES to produce an antibody reporter sequence (SEQ ID NO: 573). The reporter sequence was cloned into 33 different vectors, operably linking it to the regulatory elements shown in columns B-G. Some vectors also comprised viral origins of replication (column G) and replication proteins (column H). Abbreviations are as follows; murine CMV immediate early gene 1 (CMV Mm); human CMV immediate early gene 1 (CMV Hs); human translation elongation factor 1a (EF1 Hs); murine translation elongation factor 1a (EF1 Mm); adenoviral major late protein enhancer/intron (MLP); human CMV immediate early gene 1 third intron (CMVc Hs); human CMV immediate early gene 1 first intron (CMVa Hs); woodchuck hepatitis B virus post-transcriptional regulatory element (WPRE); rabbit beta globin (Globin Oc); simian virus 40 (SV40); simian virus 40 large T antigen (SV40 T); bovine growth hormone (BGH); hamster beta-actin (actin Cg); murine beta-actin (actin Mm); chick beta-actin (actin Gg); human glyceraldehyde dehydrogenase (GAPDH Hs); murine glyceraldehyde dehydrogenase (GAPDH Mm); Epstein Barr virus origin of replication (OriP); truncated Epstein Barr virus origin of replication (OriP_min); Epstein Barr virus nuclear antigen (EBNA). Column I shows the SEQ ID NO of the combined promoter, enhancer and intron elements to the 5' of the reporter sequence.

Constructs were expressed in ExpiCHO cells as described in section 5.4.2. Column J shows the average level of expression (in μg/ml) obtained from 3 independent transfections, and column K shows the standard deviation of the titer.

Table 14. Mathematical Model Assessment of Contribution of Vector Elements to Expression in ExpiCHO.

Models were constructed analyzing the contribution to expression in ExpiCHO of a total of 34 sequence elements from 7 different groups, using the data shown in Table 13. The element group is shown in column A. The source for the element in that group is shown in column B, abbreviations are as for Table 13. The average model weight in expiCHO for each element from 1,000 models is shown in column C, and the standard deviation of that model weight is shown in column D.

Table 15. Antibody Titers from CHO Pools Transfected with Glutamine Synthetase-Encoding Transposons.

Five transposons with SEQ ID NOs shown in column B were used to generate pools of stable CHO cells by selection for active glutamine synthetase. The transposons each comprised a gene encoding a glutamine synthetase with amino acid sequence SEQ ID NO shown in column C. The SEQ ID NO for the DNA sequence with which the glutamine synthetase is encoded is shown in column D. The glutamine synthetase and its operably linked regulatory sequences comprised a sequence whose SEQ ID NO is shown in column E. Each pool was then grown for 14 days in an unoptimized fed-batch. The antibody titer is shown in column F, the viable cell density at day 14 is shown in column G, and specific productivities of each pool are shown in column H.

TABLE 1

| | A SEQ ID NO: | B PRE | C PRE SEQ ID NO | D pA | E pA SEQ ID NO | F titer (ug/ml) | G titer (ug/ml) | H titer (ug/ml) | I mean titer (ug/ml) |
|---|---|---|---|---|---|---|---|---|---|
| 1 | 205514 | WPRE | 233 | HSVTK | 225 | 185 | 205 | 247 | 212 |
| 2 | 205515 | no | none | HSVTK | 225 | 58 | 58 | 65 | 60 |
| 3 | 205516 | no | none | globin | 212 | 50 | 55 | 57 | 54 |
| 4 | 205517 | WPRE | 233 | globin | 212 | 179 | 191 | 223 | 198 |
| 5 | 207722 | AGS 1 | 234 | globin | 212 | 95 | 96 | 113 | 101 |
| 6 | 207723 | AGS 3 | 235 | globin | 212 | 104 | 108 | 130 | 114 |
| 7 | 207724 | HPRE (2116) | 241 | globin | 212 | 182 | 186 | 220 | 196 |
| 8 | 207725 | HPRE+ | 240 | globin | 212 | 205 | 233 | 279 | 239 |
| 9 | 207989 | AGS 1 | 234 | HSVTK | 225 | 88 | 92 | 106 | 95 |
| 10 | 207990 | AGS 3 | 235 | HSVTK | 225 | 101 | 107 | 121 | 110 |
| 11 | 207991 | HPRE (2116) | 241 | HSVTK | 225 | 190 | 208 | 249 | 216 |
| 12 | 207992 | HPRE+ | 240 | HSVTK | 225 | 162 | 184 | 241 | 196 |
| 13 | 135081i | WPRE | 232 | HSVTK | 224 | 172 | 199 | 232 | 201 |

TABLE 2

| | A | B Delta (SEQ ID NO.) | C Gamma (SEQ ID NO.) | D Alpha (SEQ ID NO.) | E Beta (SEQ ID NO.) |
|---|---|---|---|---|---|
| 1 | A | 293 | 297 | 301 | 308 |
| 2 | G | 294 | 298 | 302 | 309 |
| 3 | H | 295 | 299 | 303 | 310 |
| 4 | W | 296 | 300 | 304 | 311 |

TABLE 3

| A Construct # | B Delta | C Gamma | D Alpha | E Beta | F PRE SEQ ID NO | G pA SEQ ID NO | H Ab titer1 | I Ab titer2 | J Ab titer3 | K Mean Ab titer |
|---|---|---|---|---|---|---|---|---|---|---|
| 1 | A | W | H | H | 242 | 212 | 104 | 123 | 121 | 116 |
| 2 | none | H | H | H | 243 | 212 | 100 | 117 | 134 | 117 |
| 3 | none | G | G | G | 244 | 212 | 94 | 92 | 86 | 91 |
| 4 | A | A | W | G | 245 | 225 | 62 | 57 | 53 | 58 |
| 5 | G | W | H | G | 246 | 225 | 53 | 109 | 95 | 85 |
| 6 | H | H | G | H | 247 | 225 | 57 | 46 | 52 | 52 |
| 7 | W | H | A | G | 248 | 212 | 81 | 76 | 58 | 72 |
| 8 | none | W | G | W | 249 | 212 | 115 | 88 | 95 | 99 |
| 9 | W | W | W | H | 250 | 225 | 128 | 114 | 108 | 117 |
| 10 | G | G | G | H | 251 | 225 | 38 | 42 | 27 | 36 |
| 11 | A | H | G | A | 252 | 225 | 68 | 60 | 65 | 64 |
| 12 | W | A | G | A | 253 | 212 | 41 | 36 | 37 | 38 |
| 13 | G | H | W | W | 254 | 212 | 74 | 83 | 91 | 83 |
| 14 | none | G | W | A | 255 | 225 | 117 | 113 | 117 | 116 |
| 15 | G | W | A | A | 256 | 225 | 100 | 102 | 110 | 104 |
| 16 | W | G | H | W | 257 | 225 | 56 | 56 | 55 | 56 |
| 17 | A | G | A | W | 258 | 212 | 85 | 66 | 75 | 75 |
| 18 | H | A | G | W | 259 | 225 | 46 | 44 | 45 | 45 |
| 19 | G | A | A | H | 260 | 212 | 54 | 28 | 47 | 43 |
| 20 | H | W | A | G | 261 | 212 | 117 | 121 | 108 | 115 |
| 21 | H | A | H | A | 262 | 212 | 53 | 52 | 51 | 52 |
| 22 | none | A | A | H | 263 | 225 | 85 | 84 | 76 | 82 |
| 23 | H | G | W | H | 264 | 212 | 94 | 97 | 96 | 96 |
| 24 | H | H | A | W | 265 | 225 | 94 | 92 | 85 | 90 |

TABLE 4

| | A Element group | B Source | C Element SEQ ID NO | D Model weight (mean) | E Model weight (standard deviation) |
|---|---|---|---|---|---|
| 1 | Alpha | A | 301 | 0.09 | 0.04 |
| 2 | Alpha | G | 302 | −0.58 | 0.05 |
| 3 | Alpha | H | 303 | 0.08 | 0.06 |
| 4 | Alpha | W | 304 | 0.41 | 0.04 |
| 5 | Beta | A | 308 | 0.10 | 0.06 |
| 6 | Beta | G | 309 | −0.09 | 0.05 |
| 7 | Beta | H | 310 | 0.08 | 0.04 |
| 8 | Beta | W | 311 | −0.10 | 0.04 |
| 9 | Delta | A | 293 | −0.08 | 0.03 |
| 10 | Delta | G | 294 | −0.48 | 0.04 |
| 11 | Delta | H | 295 | 0.13 | 0.05 |
| 12 | Delta | none | None | 0.71 | 0.04 |
| 13 | Delta | W | 296 | −0.28 | 0.06 |
| 14 | Gamma | A | 297 | −0.77 | 0.05 |
| 15 | Gamma | G | 298 | −0.16 | 0.04 |
| 16 | Gamma | H | 299 | 0.14 | 0.04 |
| 17 | Gamma | W | 300 | 0.78 | 0.04 |
| 18 | P A | globin | 212 | 0.08 | 0.02 |
| 19 | P A | HSVTK | 225 | −0.08 | 0.02 |

TABLE 5

| A Experiment# | B Delta (SEQ ID NO.) | C Gamma (SEQ ID NO.) | D Alpha (SEQ ID NO.) | E Beta (SEQ ID NO.) | F PRE (SEQ ID NO.) | G Titer (μg/ml) | H Titer (μg/ml) | I Titer (μg/ml) |
|---|---|---|---|---|---|---|---|---|
| 1 | none | 300 | 306 | 313 | 266 | 167.1 | 154.4 | 145.6 |
| 2 | 295 | 299 | 304 | 308 | 267 | 125.5 | 119.5 | 104.9 |
| 3 | 295 | 300 | 304 | 314 | 268 | 137.7 | 154.5 | 142.2 |
| 4 | 295 | 299 | 306 | 308 | 269 | 114.8 | 122.3 | 113.3 |
| 5 | none | 300 | 305 | 308 | 270 | 140.6 | 154.1 | 132.8 |
| 6 | none | 299 | 307 | 315 | 271 | 101.4 | 136.3 | 141.3 |
| 7 | 295 | 300 | 305 | 312 | 272 | 107.5 | 151.5 | 167.4 |
| 8 | 295 | 300 | 307 | 312 | 273 | 110.1 | 138.4 | 154.6 |
| 9 | none | 299 | 301 | 314 | 274 | 104.8 | 119.2 | 134.3 |
| 10 | none | 299 | 301 | 312 | 275 | 111.3 | 137 | 141.6 |
| 11 | 295 | 299 | 301 | 313 | 276 | 107.1 | 129.6 | 140.3 |
| 12 | none | 299 | 304 | 312 | 277 | 122.3 | 143.5 | 128 |
| 13 | 295 | 300 | 306 | 315 | 278 | 119.9 | 141 | 132.9 |
| 14 | none | 300 | 301 | 308 | 279 | 130.8 | 154.4 | 149 |
| 15 | 295 | 299 | 307 | 310 | 280 | 134.6 | 130.5 | 140.3 |
| 16 | 295 | 300 | 304 | 315 | 281 | 148 | 141.8 | 146.9 |
| 17 | 295 | 299 | 307 | 313 | 282 | 147.9 | 144.7 | 150.3 |
| 18 | 295 | 300 | 301 | 310 | 283 | 102 | 112.3 | 115.8 |
| 19 | none | 300 | 305 | 310 | 284 | 139 | 142.2 | 167.9 |
| 20 | none | 299 | 306 | 310 | 285 | 102.7 | 110.1 | 122.7 |
| 21 | none | 300 | 307 | 314 | 286 | 135.4 | 144.9 | 155.6 |
| 22 | none | 299 | 305 | 315 | 287 | 134.6 | 127.4 | 139.7 |
| 23 | none | 300 | 304 | 313 | 288 | 155.7 | 158.7 | 195.5 |
| 24 | 295 | 299 | 305 | 314 | 289 | 125.4 | 126.8 | 119 |
| 25 | none | none | none | none | none | 61.3 | 64.4 | 55.9 |

TABLE 6

| | A Sub-element group | B origin | C SEQ ID NO | D wt | E wt std |
|---|---|---|---|---|---|
| 1 | Delta | H | 295 | −0.109 | 0.016 |
| 2 | Delta | none | N/A | 0.109 | 0.016 |
| 3 | Gamma | H | 299 | 0.045 | 0.065 |
| 4 | Gamma | W | 300 | 0.449 | 0.070 |
| 5 | Gamma | none | N/A | −0.493 | 0.131 |
| 6 | Alpha | H (x−) | 307 | 0.225 | 0.043 |
| 7 | Alpha | wpre | 304 | 0.229 | 0.036 |
| 8 | Alpha | W (x−) | 305 | 0.223 | 0.037 |
| 9 | Alpha | A (x−) | 306 | −0.071 | 0.039 |
| 10 | Alpha | A | 301 | −0.113 | 0.053 |
| 11 | Alpha | none | N/A | −0.493 | 0.131 |
| 12 | Beta | W (long x−) | 313 | 0.506 | 0.037 |
| 13 | Beta | H (x−) | 315 | 0.023 | 0.035 |
| 14 | Beta | A (long x−) | 314 | 0.012 | 0.036 |
| 15 | Beta | W (long) | 312 | 0.037 | 0.042 |
| 16 | Beta | H | 310 | −0.088 | 0.064 |
| 17 | Beta | A | 308 | 0.002 | 0.049 |
| 18 | Beta | none | N/A | −0.493 | 0.131 |

TABLE 7

| A SEQ ID NO. | B Mean GFP fluorescence | C Mean RFP fluorescence | D Adjusted RFP fluorescence | E GFP/RFP | F sum |
|---|---|---|---|---|---|
| 1 | 560 | 11,699 | 5,465 | 13,662 | 0.86 | 25,303 |
| 2 | 561 | 21,951 | 4,851 | 12,129 | 1.81 | 33,991 |
| 3 | 562 | 6,339 | 7,249 | 18,123 | 0.35 | 24,442 |
| 4 | 563 | 15,548 | 6,295 | 15,738 | 0.99 | 30,603 |

TABLE 8

| A Transposon ID | B pA1-P2 SEQ ID NO | C PRE | D PRE SEQ ID NO | E ORF1 (mg/L) | F ORF2 (mg/L) | G ORF1/ ORF2 |
|---|---|---|---|---|---|---|
| 297916 | 566 | WPRE | 236 | 1,447 | 554 | 2.61 |
| 297918 | 566 | PRE R1V8 | 249 | 1,351 | 566 | 2.39 |
| 297920 | 566 | PRE R1V22 | 263 | 1,347 | 574 | 2.35 |
| 297921 | 566 | PRE R1V11 | 252 | 1,115 | 481 | 2.32 |
| 297919 | 566 | PRE R1V20 | 261 | 1,075 | 559 | 1.92 |
| 297922 | 566 | PRE R1V21 | 262 | 879 | 529 | 1.66 |
| 297974 | 566 | HPREx- | 237 | 1,029 | 644 | 1.60 |
| 297923 | 567 | WPRE | 236 | 1,360 | 971 | 1.40 |
| 297924 | 567 | HPRE(2752) | 240 | 1,019 | 953 | 1.07 |
| 297925 | 567 | PRE R1V8 | 249 | 869 | 866 | 1.00 |
| 297975 | 567 | AGSPRE_1x- | 238 | 888 | 910 | 0.98 |
| 297927 | 567 | PRE R1V22 | 263 | 910 | 988 | 0.92 |
| 297926 | 567 | PRE R1V20 | 261 | 790 | 925 | 0.85 |
| 297928 | 567 | PRE R1V11 | 252 | 647 | 853 | 0.76 |
| 297929 | 567 | PRE R1V21 | 262 | 600 | 866 | 0.69 |

TABLE 9

|   | A | B | C | D | E | F | G |
|---|---|---|---|---|---|---|---|
| 1 | Enhancer | CMV Mm | CMV Hs | none | n/a | n/a | 3 |
| 2 | Promoter | CMV Mm | CMV Hs | EF1 Hs | EF1 Mm | n/a | 4 |
| 3 | Intron | CMVc | EF1 Hs | EF1 Mm | MLP | none | 5 |
| 4 | PRE | HPRE | WPRE | none | n/a | n/a | 3 |
| 5 | 3' utr | a-globin | none | n/a | n/a | n/a | 2 |
| 6 | polyA | b-globin | SV40 | BGH | CMV Hs | n/a | 4 |

TABLE 10

| A Configuration# | B Enhancer | C Promoter | D Intron | E PRE | F 3' UTR | G polyA | H 5' SEQ ID NO | I 3' SEQ ID NO | J HEK | K CHO | L ExpiCHO |
|---|---|---|---|---|---|---|---|---|---|---|---|
| 300206 | CMV Mm | EF1 Hs | CMVc | HPRE | aglobin | globin | 342 | 446 | 286 | 93 | 779 |
| 300207 | CMV Hs | EF1 Mm | CMVc | none | none | bgh | 333 | 456 | 218 | 86 | 720 |
| 300208 | CMV Mm | EF1 Hs | eMLP | HPRE | none | CMV Hs | 345 | 441 | 296 | 63 | 591 |
| 300209 | CMV Hs | CMV Mm | CMVc | HPRE | none | CMV Hs | 329 | 441 | 591 | 84 | 951 |
| 300210 | none | EF1 Hs | CMVc | none | none | CMV Hs | 356 | 455 | 42 | 33 | 229 |
| 300211 | none | CMV Mm | eMLP | none | none | SV40 | 355 | 453 | 338 | 74 | 606 |
| 300212 | CMV Hs | CMV Mm | CMVc | WPRE | aglobin | bgh | 327 | 433 | 655 | 107 | 595 |
| 300213 | none | CMV Hs | eMLP | none | aglobin | globin | 352 | 450 | 670 | 51 | 616 |
| 300214 | CMV Hs | CMV Hs | EF1 Hs | none | aglobin | SV40 | 324 | 449 | 732 | 75 | 962 |
| 300215 | CMV Hs | CMV Mm | EF1 Hs | WPRE | none | CMV Hs | 328 | 434 | 333 | 57 | 340 |
| 300216 | CMV Hs | EF1 Hs | eMLP | none | aglobin | globin | 332 | 450 | 330 | 74 | 469 |
| 300217 | CMV Hs | CMV Hs | eMLP | WPRE | none | bgh | 326 | 435 | 963 | 75 | 740 |
| 300218 | none | CMV Hs | EF1 Hs | HPRE | none | bgh | 350 | 442 | 700 | 62 | 545 |
| 300219 | none | EF1 Mm | CMVc | none | none | CMV Hs | 358 | 455 | 82 | 48 | 255 |
| 300220 | CMV Hs | EF1 Mm | CMVc | HPRE | none | globin | 333 | 443 | 424 | 71 | 466 |
| 300221 | CMV Hs | EF1 Hs | EF1 Mm | WPRE | none | globin | 331 | 436 | 366 | 68 | 420 |
| 300222 | CMV Hs | EF1 Hs | eMLP | HPRE | aglobin | bgh | 332 | 444 | 436 | 77 | 506 |
| 300223 | CMV Mm | CMV Hs | CMVc | WPRE | none | CMV Hs | 335 | 434 | 576 | 66 | 279 |
| 300224 | none | CMV Hs | CMVc | HPRE | aglobin | globin | 349 | 446 | 529 | 68 | 716 |
| 300225 | CMV Mm | EF1 Mm | EF1 Mm | HPRE | aglobin | SV40 | 347 | 445 | 343 | 74 | 407 |
| 300226 | none | EF1 Mm | EF1 Hs | WPRE | aglobin | globin | 359 | 437 | 299 | 62 | 346 |
| 300227 | CMV Mm | CMV Hs | eMLP | none | none | globin | 338 | 454 | 734 | 67 | 916 |
| 300228 | none | EF1 Hs | EF1 Hs | WPRE | none | SV40 | 361 | 438 | 248 | 52 | 207 |
| 300229 | none | CMV Hs | EF1 Mm | HPRE | aglobin | bgh | 351 | 444 | 763 | 67 | 704 |
| 300230 | none | EF1 Hs | EF1 Mm | WPRE | none | bgh | 357 | 435 | 219 | 57 | 268 |
| 300231 | none | CMV Mm | EF1 Hs | HPRE | none | bgh | 353 | 442 | 213 | 64 | 496 |
| 300232 | none | EF1 Mm | eMLP | WPRE | aglobin | CMV Hs | 360 | 440 | 237 | 47 | 200 |
| 300233 | CMV Mm | CMV Mm | EF1 Mm | none | none | globin | 340 | 454 | 259 | 67 | 1012 |
| 300234 | CMV Hs | CMV Mm | EF1 Hs | HPRE | aglobin | globin | 328 | 446 | 418 | 79 | 940 |
| 300235 | CMV Mm | EF1 Mm | EF1 Hs | none | none | bgh | 346 | 456 | 247 | 64 | 354 |
| 300236 | CMV Hs | EF1 Hs | EF1 Hs | none | aglobin | CMV Hs | 330 | 451 | 165 | 60 | 483 |
| 300237 | CMV Mm | CMV Hs | eMLP | WPRE | aglobin | bgh | 348 | 433 | 346 | 65 | 627 |
| 300238 | CMV Mm | CMV Hs | EF1 Mm | HPRE | none | SV40 | 325 | 447 | 725 | 90 | 584 |
| 300239 | CMV Mm | EF1 Hs | EF1 Mm | none | none | bgh | 344 | 456 | 181 | 81 | 268 |
| 300240 | CMV Hs | EF1 Mm | EF1 Mm | HPRE | none | CMV Hs | 334 | 441 | 293 | 63 | 301 |
| 300241 | CMV Hs | CMV Hs | CMVc | WPRE | none | SV40 | 323 | 438 | 840 | 90 | 476 |
| 300242 | CMV Mm | CMV Mm | CMVc | HPRE | none | SV40 | 339 | 447 | 600 | 135 | 601 |

TABLE 10-continued

| A Configuration# | B Enhancer | C Promoter | D Intron | E PRE | F 3' UTR | G polyA | H 5' SEQ ID NO | I 3' SEQ ID NO | J HEK | K CHO | L ExpiCHO |
|---|---|---|---|---|---|---|---|---|---|---|---|
| 300243 | none | CMV Mm | EF1 Mm | WPRE | none | globin | 354 | 436 | 185 | 61 | 498 |
| 300244 | CMV Hs | EF1 Mm | EF1 Mm | none | aglobin | SV40 | 334 | 449 | 292 | 84 | 250 |
| 300245 | CMV Mm | CMV Hs | EF1 Hs | none | none | SV40 | 336 | 453 | 629 | 78 | 793 |
| 300246 | CMV Mm | CMV Mm | eMLP | WPRE | aglobin | SV40 | 341 | 439 | 599 | 51 | 1228 |
| 300247 | none | EF1 Mm | eMLP | HPRE | none | SV40 | 360 | 447 | 211 | 44 | 245 |
| 300248 | none | EF1 Hs | CMVc | WPRE | aglobin | SV40 | 356 | 439 | 257 | 55 | 320 |
| 300249 | CMV Mm | CMV Mm | CMVc | none | aglobin | bgh | 339 | 452 | 561 | 125 | 934 |
| 300250 | CMV Mm | EF1 Hs | EF1 Hs | HPRE | aglobin | CMV Hs | 343 | 448 | 214 | 62 | 324 |
| 300251 | none | CMV Hs | EF1 Mm | none | aglobin | CMV Hs | 354 | 451 | 106 | 53 | 785 |
| 300252 | CMV Mm | CMV Hs | EF1 Mm | WPRE | aglobin | CMV Hs | 337 | 440 | 671 | 67 | 567 |
| 300253 | CMV Mm | EF1 Mm | EF1 Hs | WPRE | none | globin | 346 | 436 | 289 | 62 | 406 |
| 300254 | CMV Hs | CMV Mm | none | none | none | globin | 362 | 454 | 404 | 63 | 1280 |
| 300255 | CMV Mm | CMV Mm | none | none | aglobin | bgh | 363 | 452 | 422 | 119 | 1222 |
| 300256 | CMV Hs | CMV Mm | none | HPRE | none | CMV Hs | 362 | 448 | 546 | 68 | 754 |
| 300257 | CMV Mm | CMV Mm | none | HPRE | none | globin | 363 | 443 | 480 | 88 | 506 |
| 300258 | CMV Hs | CMV Mm | none | WPRE | aglobin | CMV Hs | 362 | 440 | 635 | 79 | 1234 |
| 300259 | CMV Hs | CMV Hs | none | none | aglobin | SV40 | 364 | 449 | 780 | 71 | 1056 |
| 300260 | CMV Hs | CMV Hs | none | HPRE | none | SV40 | 364 | 447 | 1000 | 58 | 731 |
| 300261 | CMV Mm | CMV Hs | none | none | none | CMV Hs | 365 | 455 | 536 | 43 | 1046 |
| 300262 | CMV Mm | CMV Mm | none | WPRE | none | SV40 | 363 | 438 | 576 | 83 | 617 |
| 300263 | CMV Mm | CMV Hs | none | HPRE | aglobin | bgh | 365 | 444 | 860 | 83 | 646 |
| 300264 | CMV Mm | CMV Hs | none | WPRE | aglobin | globin | 365 | 437 | 865 | 83 | 667 |
| 300265 | CMV Hs | CMV Hs | none | WPRE | none | bgh | 364 | 435 | 915 | 69 | 601 |

TABLE 11

| | A variable | B element | C SEQ ID NO. | D HEK weight (av) | E HEK weight (std) | F CHO-S weight (av) | G CHO-S weight (std) | H expiCHO weight (av) | I expiCHO weight (std) |
|---|---|---|---|---|---|---|---|---|---|
| 1 | Enhancer | CMV Hs | 11 | 0.149 | 0.009 | 0.086 | 0.011 | 0.092 | 0.025 |
| 2 | Enhancer | none | N/A | −0.177 | 0.013 | −0.214 | 0.013 | −0.179 | 0.016 |
| 3 | Enhancer | CMV Mm | 24 | 0.028 | 0.010 | 0.128 | 0.014 | 0.087 | 0.022 |
| 4 | Promoter | CMV Hs | 52 | 0.539 | 0.012 | −0.024 | 0.012 | 0.107 | 0.019 |
| 5 | Promoter | CMV Mm | 54 | −0.007 | 0.013 | 0.182 | 0.021 | 0.234 | 0.024 |
| 6 | Promoter | EF1 Hs | 36 | −0.278 | 0.011 | −0.070 | 0.013 | −0.161 | 0.018 |
| 7 | Promoter | EF1 Mm | 41 | −0.253 | 0.014 | −0.088 | 0.016 | −0.180 | 0.023 |
| 8 | Intron | EF1 Hs | 107 | −0.092 | 0.014 | −0.059 | 0.015 | −0.074 | 0.018 |
| 9 | Intron | MLP | 139 | 0.100 | 0.012 | −0.075 | 0.023 | 0.023 | 0.021 |
| 10 | Intron | CMVc | 97 | −0.001 | 0.020 | 0.202 | 0.020 | −0.063 | 0.017 |
| 11 | Intron | EF1 Mm | 111 | −0.104 | 0.012 | 0.014 | 0.015 | −0.083 | 0.017 |
| 12 | Intron | none | N/A | 0.098 | 0.016 | −0.082 | 0.022 | 0.197 | 0.017 |
| 13 | RNA export | none | N/A | −0.143 | 0.010 | −0.011 | 0.012 | 0.132 | 0.024 |
| 14 | RNA export | WPRE | 233 | 0.086 | 0.010 | −0.042 | 0.014 | −0.028 | 0.021 |
| 15 | RNA export | HPRE | 240 | 0.057 | 0.011 | 0.052 | 0.012 | −0.104 | 0.022 |
| 16 | 3' UTR | a-globin Hs | 579 | 0.032 | 0.007 | 0.048 | 0.009 | 0.119 | 0.020 |
| 17 | 3' UTR | none | N/A | −0.032 | 0.007 | −0.048 | 0.009 | −0.119 | 0.020 |
| 18 | poly adenylation | SV40 | 227 | 0.080 | 0.010 | 0.059 | 0.020 | −0.006 | 0.022 |
| 19 | poly adenylation | CMV Hs | 206 | −0.132 | 0.011 | −0.183 | 0.015 | −0.054 | 0.023 |
| 20 | poly adenylation | b-globin | 214 | −0.028 | 0.014 | −0.020 | 0.016 | 0.057 | 0.019 |
| 21 | poly adenylation | BGH | 206 | 0.080 | 0.012 | 0.144 | 0.014 | 0.003 | 0.020 |

TABLE 12

| | A Construct | B Construct SEQ ID NO | C Enhancer source | D Promoter source | E Intron source | F Enhancer | G Promoter | H Intron | I avg | J std |
|---|---|---|---|---|---|---|---|---|---|---|
| 1 | 294058 | 148 | human | human | human | 13 | 48 | 102 | 895 | 145 |
| 2 | 294057 | 149 | human | human | human | 13 | 48 | 102 | 833 | 76 |
| 3 | 294061 | 150 | human | human | human | 11 | 49 | 104 | 803 | 66 |
| 4 | 294062 | 151 | human | human | human | 11 | 49 | 104 | 788 | 19 |
| 5 | 294059 | 152 | human | human | human | 13 | 48 | 102 | 788 | 168 |
| 6 | 302311 | 153 | chimpanzee | chimpanzee | chimpanzee | 16 | 58 | 105 | 775 | 9 |
| 7 | 302312 | 154 | human | human | chimpanzee | 13 | 48 | 105 | 742 | 66 |
| 8 | 294054 | 155 | human | human | human | 11 | 49 | 140 | 700 | 81 |

TABLE 12-continued

| | A Construct | B Construct SEQ ID NO | C Enhancer source | D Promoter source | E Intron source | F Enhancer | G Promoter | H Intron | I avg | J std |
|---|---|---|---|---|---|---|---|---|---|---|
| 9 | 302310 | 156 | chimpanzee | chimpanzee | chimpanzee | 16 | 58 | 99 | 652 | 47 |
| 10 | 302309 | 157 | human | human | chimpanzee | 13 | 48 | 99 | 624 | 95 |
| 11 | 302313 | 158 | human | human | mouse | 14 | 52 | 100 | 623 | 55 |

TABLE 13

| | A Gene ID | B Enhancer | C Promoter | D Intron | E PRE | F Polyadenylation signal | G Viral Ori | H Viral replication protein | I Upstream SEQ ID NO. | J avg | K std |
|---|---|---|---|---|---|---|---|---|---|---|---|
| 1 | 217566 | CMV Hs | CMV Hs | none | none | Globin Oc | none | none | 159 | 300 | 22.1 |
| 2 | 217570 | CMV Hs | actin Gg | actin Gg | none | BGH | SV40 | SV40 T | 160 | 25 | 1.9 |
| 3 | 217574 | CMV Hs | CMV Hs | CMVc Hs | none | Globin Oc | none | none | 161 | 330 | 20.2 |
| 4 | 217578 | CMV Hs | GAPDH Hs | actin Gg | none | Globin Oc | none | none | 162 | 72 | 4.0 |
| 5 | 217582 | CMV Hs | CMV Hs | CMVa Hs | none | Globin Oc | SV40 | SV40 T | 163 | 226 | 7.0 |
| 6 | 217586 | CMV Hs | CMV Hs | CMVa Hs | none | Globin Oc | none | none | 164 | 279 | 3.8 |
| 7 | 217590 | CMV Hs | GAPDH Hs | GAPDH Hs | none | HSVTK | none | none | 165 | 39 | 1.9 |
| 8 | 217594 | CMV Hs | EF1a Hs | none | none | BGH | none | none | 166 | 144 | 9.2 |
| 9 | 217610 | CMV Hs | CMV Hs | CMVa Hs | none | SV40 | SV40 | SV40 T | 167 | 183 | 5.7 |
| 10 | 217614 | CMV Hs | GAPDH Hs | none | none | Globin Oc | none | none | 168 | 79 | 3.5 |
| 11 | 217618 | CMV Hs | EF1a Hs | EF1a Hs | none | Globin Oc | SV40 | SV40 T | 169 | 97 | 4.1 |
| 12 | 217622 | CMV Hs | CMV Hs | CMVa Hs | none | Globin Oc | OriP | none | 170 | 241 | 9.8 |
| 13 | 217626 | CMV Hs | CMV Hs | CMVa Hs | none | BGH | OriP | EBNA | 171 | 239 | 20.1 |
| 14 | 217630 | CMV Hs | CMV Hs | none | none | SV40 | none | none | 172 | 266 | 11.4 |
| 15 | 217634 | CMV Hs | GAPDH Hs | GAPDH Hs | none | Globin Oc | none | none | 173 | 95 | 9.3 |
| 16 | 217638 | SV40 | SV40E | none | none | Globin Hs | none | none | 174 | 111 | 6.7 |
| 17 | 217642 | CMV Hs | EF1a Hs | EF1a Hs | none | Globin Oc | SV40 | SV40 T | 175 | 97 | 4.7 |
| 18 | 217927 | CMV Hs | CMV Hs | MLP | none | Globin Oc | OriP_min | none | 176 | 210 | 8.2 |
| 19 | 217933 | CMV Hs | CMV Hs | CMVa Hs | none | Globin Oc | OriP_min | none | 177 | 224 | 4.4 |
| 20 | 218554 | CMV Hs | CMV Hs | MLP | none | Globin Oc | none | none | 178 | 302 | 10.5 |
| 21 | 218560 | CMV Hs | GAPDH Hs | CMVc Hs | none | Globin Oc | none | none | 179 | 105 | 6.3 |
| 22 | 218588 | none | EF1a Hs | MLP | none | Globin Oc | none | none | 180 | 37 | 0.7 |
| 23 | 218594 | CMV Hs | GAPDH Hs | MLP | none | Globin Oc | none | none | 181 | 111 | 8.1 |
| 24 | 218600 | CMV Hs | GAPDH Hs | CMVc Hs | none | Globin Oc | OriP_min | none | 182 | 67 | 1.2 |
| 25 | 218606 | none | EF1a Hs | MLP | none | Globin Oc | OriP_min | none | 183 | 30 | 1.8 |
| 26 | 235972 | CMV Hs | CMV Hs | none | WPRE | HSVTK | none | none | 184 | 216 | 14.1 |
| 27 | 296226 | CMV Hs | EF1a Hs | EF1a-Hs | none | Globin Oc | OriP_min | EBNA | 185 | 141 | 8.6 |
| 28 | 296227 | CMV Hs | EF1a Hs | none | none | Globin Oc | OriP | EBNA | 186 | 131 | 18.5 |
| 29 | 296233 | CMV Mm | GAPDH Mm | GAPDH Mm | none | Globin Oc | none | none | 187 | 292 | 12.3 |
| 30 | 296234 | CMV Mm | actin Cg | actin Cg | none | Globin Oc | none | none | 188 | 312 | 34.1 |
| 31 | 296235 | CMV Mm | CMV Mm | EF1a Hs | none | Globin Oc | none | none | 189 | 283 | 6.2 |
| 32 | 296236 | CMV Mm | actin Mm | actin Mm | none | Globin Oc | none | none | 190 | 289 | 2.8 |
| 33 | 296239 | CMV Hs | CMV Hs | none | none | Globin Oc | none | none | 191 | 280 | 18.2 |

TABLE 14

| | A Category | B Element | C SEQ ID NO | D weight | SD |
|---|---|---|---|---|---|
| 1 | Enhancer | CMV Hs | 11 | 0.06 | 0.04 |
| 2 | Enhancer | CMV Mm | 23 | 0.46 | 0.03 |
| 3 | Enhancer | NONE | N/A | −0.42 | 0.07 |
| 4 | Enhancer | SV40 | 28 | −0.10 | 0.03 |
| 5 | Intron | actin Cg | 132 | 0.17 | 0.05 |
| 6 | Intron | actin Gg | 122 | −0.26 | 0.03 |
| 7 | Intron | actin Mm | 133 | 0.10 | 0.03 |
| 8 | Intron | CMVa Hs | 92 | −0.12 | 0.03 |
| 9 | Intron | CMVc Hs | 97 | 0.11 | 0.05 |
| 10 | Intron | EF1 Hs | 107 | 0.09 | 0.03 |
| 11 | Intron | eMLP | 140 | −0.06 | 0.04 |
| 12 | Intron | GADPDH Mm | 138 | 0.11 | 0.04 |
| 13 | Intron | GAPDH Hs | 136 | −0.10 | 0.02 |
| 14 | Intron | NONE | N/A | −0.04 | 0.04 |
| 15 | Origin of replication | NONE | N/A | 0.20 | 0.02 |
| 16 | Origin of replication | OriP | 584 | −0.06 | 0.03 |
| 17 | Origin of replication | OriP min | 583 | −0.14 | 0.03 |
| 18 | Polyadenylation signal | BGH | 206 | 0.08 | 0.05 |
| 19 | Polyadenylation signal | Globin Hs | 210 | −0.10 | 0.03 |
| 20 | Polyadenylation signal | Globin Oc | 212 | 0.19 | 0.02 |
| 21 | Polyadenylation signal | HSV TK | 225 | −0.18 | 0.04 |
| 22 | Polyadenylation signal | SV40 | 220 | 0.01 | 0.03 |
| 23 | Promoter | actin Cg | 71 | 0.17 | 0.05 |
| 24 | Promoter | actin Gg | 67 | −0.16 | 0.05 |
| 25 | Promoter | actin Mm | 73 | 0.10 | 0.03 |
| 26 | Promoter | CMV Hs | 49 | 0.67 | 0.03 |
| 27 | Promoter | CMV Mm | 54 | 0.08 | 0.03 |
| 28 | Promoter | EF1 Hs | 36 | −0.27 | 0.04 |
| 29 | Promoter | GADPDH Mm | 78 | 0.11 | 0.04 |
| 30 | Promoter | GAPDH Hs | 77 | −0.60 | 0.04 |
| 31 | Promoter | SV40 | 580 | −0.10 | 0.03 |
| 32 | Viral replication protein | EBNA | 582 | 0.21 | 0.04 |
| 33 | Viral replication protein | NONE | N/A | 0.12 | 0.03 |
| 34 | Viral replication protein | SV40 T antigen | 581 | −0.33 | 0.03 |

TABLE 15

| A Construct | B SEQ ID NO. | C Amino acid (SEQ ID NO.) | D GS DNA (SEQ ID NO.) | E DNA for GS and control elements (SEQ ID NO.) | F Titer µg/ml | G Viable Cell Density ×10^6 cells/ml | H Specific Productivity µg/×10^6 cells |
|---|---|---|---|---|---|---|---|
| 314586 | 576 | 506 | 512 | 530 | 1,718 | 15.98 | 107 |
| 314587 | 575 | 505 | 511 | 533 | 1,540 | 10.91 | 141 |
| 314588 | 574 | 504 | 510 | 532 | 1,559 | 10.56 | 148 |
| 303539 | 578 | 503 | 509 | 529 | 1,732 | 15.06 | 115 |
| 317168 | 577 | 503 | 509 | 539 | 2,099 | 10.68 | 197 |

8. REFERENCES

All references cited herein are incorporated herein by reference in their entirety and for all purposes to the same extent as if each individual publication or patent or patent application was specifically and individually indicated to be incorporated by reference in its entirety for all purposes.

Many modifications and variations of this invention can be made without departing from its spirit and scope, as will be apparent to those skilled in the art. The specific embodiments described herein are offered by way of example only, and the invention is to be limited only by the terms of the appended claims, along with the full scope of equivalents to which such claims are entitled.

SEQUENCE LISTING (584 sequences)

SEQ ID NO: 1 - DNA, 145 bp, Artificial sequence
  Synthetic sequence
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 2 - DNA, 145 bp, Artificial sequence
  Synthetic sequence
ttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 3 - DNA, 168 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgta

SEQ ID NO: 4 - DNA, 185 bp, Artificial sequence
  Synthetic sequence
ttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgta

SEQ ID NO: 5 - DNA, 128 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 6 - DNA, 145 bp, Artificial sequence
  Synthetic sequence
ttgcccactccctctatgcgcgctcgctcgctcggtggggcctgcggaccaaaggtccgcagacggcagagctctgctctgccggccccaccgagcgagcgagcgcgcatagagggagtgggcaactccatcactaggggtattc

SEQ ID NO: 7 - DNA, 14 bp, Artificial sequence
  Synthetic sequence
ccytttbmctgcca

SEQ ID NO: 8 - DNA, 16 bp, Artificial sequence
  Synthetic sequence
cccggcgagcatgagg

SEQ ID NO: 9 - DNA, 16 bp, Artificial sequence
  Synthetic sequence
cctcatgctcgccggg

SEQ ID NO: 10 - DNA, 13 bp, Artificial sequence
  Synthetic sequence
ccctagaaagata

SEQ ID NO: 11 - DNA, 293 bp, Homo sapiens
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattacca

SEQ ID NO: 12 - DNA, 364 bp, Homo sapiens
actagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 13 - DNA, 375 bp, Homo sapiens
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 14 - DNA, 375 bp, Homo sapiens
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattacca

SEQ ID NO: 15 - DNA, 374 bp, Homo sapiens
attgattattgagtagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacggttagtcatcgctattacca

SEQ ID NO: 16 - DNA, 305 bp, Homo sapiens
ccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 17 - DNA, 275 bp, Homo sapiens
acttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattacca

SEQ ID NO: 18 - DNA, 293 bp, Homo sapiens
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 19 - DNA, 292 bp, Homo sapiens
actacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 20 - DNA, 293 bp, Homo sapiens
acttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 21 - DNA, 412 bp, Mus musculus
gtcagtgtacttggctccaatgggtttttcccattgactcatcccctattgaccttatgtactgggcaaaacccaatggaaagtccctattgacgcagtgtacttggctccaatgggactttcctgttgattcaccccctattgaccttatgtactgggcagaatacaatggaaagtccctattgactcacccacattgaccttatatgcttgccaacaatggaaaaacccattggaaagtccctattgagtcagtgtacttggcagcaatgggtttttcccattggctcacctcccattgacccaatgtacttgggcaaaacccagtggaaagtcccatttgactcagtgtgcttgccagtaatgggaaaaacccattggcttacctcccattgacccaatgtacttgggt

SEQ ID NO: 22 - DNA, 294 bp, Mus musculus
tgagtcaatagggactttccaatgggttttgcccagtacataaggtcaatgggaggtaagccaatgggtttttcccattactggcacgtatactgagtcattagggactttccaatgggttttgcccagtacataaggtcaataggggtgaatcaacaggaaagttccattggagccaagtacactgagtcaatagggactttccattgggttttgcccagtacaaaaggtcaatagggggtgagtcaatgggtttttcccattattggcacgtacataaggtcaataggggtg

SEQ ID NO: 23 - DNA, 423 bp, Mus musculus
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtg

SEQ ID NO: 24 - DNA, 206 bp, Mus musculus
tatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtg

SEQ ID NO: 25 - DNA, 106 bp, Mus musculus
ccattggagccaagtacactgagtcaatagggactttccattgggttttgcccagtacaaaaggtcaatagggggtgagtcaatgggtttttcccattattggcac

SEQ ID NO: 26 - DNA, 292 bp, Pan troglodytes
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtat

SEQ ID NO: 27 - DNA, 102 bp, Artificial sequence
  Synthetic sequence
ccagctgttggggtgagtactccctctcaaaagcgggcattacttctgcgctaagattgtcagtttccaaaaacgaggaggatttgatattcacctggcccg

SEQ ID NO: 28 - DNA, 144 bp, Artificial sequence
  Synthetic sequence
ggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaacca

SEQ ID NO: 29 - DNA, 178 bp, Artificial sequence
  Synthetic sequence
gcacatcgcccacagtccccgagaagttggggggaggctctggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 30 - DNA, 369 bp, Artificial sequence
  Synthetic sequence
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 31 - DNA, 369 bp, Artificial sequence
  Synthetic sequence
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 32 - DNA, 372 bp, Artificial sequence
  Synthetic sequence
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 33 - DNA, 372 bp, Artificial sequence
  Synthetic sequence
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 34 - DNA, 372 bp, Artificial sequence
  Synthetic sequence
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 35 - DNA, 570 bp, Artificial sequence
  Synthetic sequence
ctgggctgagacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 36 - DNA, 168 bp, Artificial sequence
  Synthetic sequence
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 37 - DNA, 171 bp, Artificial sequence
  Synthetic sequence
gcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 38 - DNA, 171 bp, Artificial sequence
  Synthetic sequence
gcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 39 - DNA, 168 bp, Artificial sequence
  Synthetic sequence
gcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 40 - DNA, 171 bp, Artificial sequence
  Synthetic sequence
gcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 41 - DNA, 440 bp, Artificial sequence
  Synthetic sequence
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 42 - DNA, 480 bp, Artificial sequence
  Synthetic sequence
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttc

SEQ ID NO: 43 - DNA, 316 bp, Artificial sequence
  Synthetic sequence
ggagccgagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgtt

SEQ ID NO: 44 - DNA, 503 bp, Artificial sequence
  Synthetic sequence
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 45 - DNA, 503 bp, Artificial sequence
  Synthetic sequence
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcttcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 46 - DNA, 301 bp, Artificial sequence
  Synthetic sequence
ggagccgagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 47 - DNA, 459 bp, Artificial sequence
  Synthetic sequence
ggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgtt

SEQ ID NO: 48 - DNA, 220 bp, Artificial sequence
  Synthetic sequence
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 49 - DNA, 220 bp, Artificial sequence
  Synthetic sequence
tgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 50 - DNA, 220 bp, Artificial sequence
  Synthetic sequence
tagtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 51 - DNA, 220 bp, Artificial sequence
  Synthetic sequence
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgcgtttagtgaaccg

SEQ ID NO: 52 - DNA, 220 bp, Artificial sequence
  Synthetic sequence
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 53 - DNA, 314 bp, Artificial sequence
  Synthetic sequence
agtcattgggtttttccagccatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcactcattctattggctgagctgcgttctacgtgggtataagaggcgcgaccagcgtcggtaccgtcgcagtcttcggtctgaccaccgtag

SEQ ID NO: 54 - DNA, 313 bp, Artificial sequence
  Synthetic sequence
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtag

SEQ ID NO: 55 - DNA, 315 bp, Artificial sequence
  Synthetic sequence
agtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtag

SEQ ID NO: 56 - DNA, 283 bp, Artificial sequence
  Synthetic sequence
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggta

SEQ ID NO: 57 - DNA, 293 bp, Artificial sequence
  Synthetic sequence
aaaggccattgagtcaccacccctatgctgggaaatggtgaacgccccctatgtggaaagtccctatgggccgccattagagtgcatgaccgtgctgattcatatgccatatgagtgtattagggggctttccgcgtgggaaattgggtaaaaagtccccgtattactcacatagggggcgtttggctttgcaaattaggggatttcagtgcatttggcattaaaaactattggttctagtcataaaacgggcggagttaaccatataattgctgtcccccatgccattcgag

SEQ ID NO: 58 - DNA, 238 bp, Artificial sequence
  Synthetic sequence
tactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccg

SEQ ID NO: 59 - DNA, 783 bp, Artificial sequence
  Synthetic sequence
tattaatagcaatcttagctaattaaaatagatagcgtttattgagcgttgggtatcaggcacggtcctaattcttttagatgtctttagttcgtttcactctcccccaaacaatagggtggtattgatcacctccgagcaggtgaaattgaggcacagagaaatcctagtagctggtagaagaacacgcagtgtggtcaagctagcaaggtgtttggtccactgctatatctacaaaacccctaacaatgcctggtgtatagatgctcagtatgcatttgtgggatcagtgattccgatgcctgcttcttataaagtttttatttagaaataattacaggtaaggagttgcaaaaacagtatagtgggatcgagtgtcctttttccctcggcttctcccaggggtatcgtcttacgtaacaatgtccaaacagggaaattgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 60 - DNA, 335 bp, Artificial sequence
  Synthetic sequence
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgcaggttctcgcacgcgcacatcatcccgcaggcgagccccagcacccagcccagggtgcgcgcgcgccgtcacgtgacacgcccaaccggcgtcgccgtataaaagcgcgggcgttgacgtcagcggt

SEQ ID NO: 61 - DNA, 335 bp, Artificial sequence
  Synthetic sequence
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgctggttctcgcacgcgcacatcatcccgcaggcgagccccagcacccagcccagggtgcgcgcgcgccgtcacgtgacacgcccaaccggcgtcgccgtataaaagcgcgggcgttgacgtcagcgtt

SEQ ID NO: 62 - DNA, 343 bp, Artificial sequence
  Synthetic sequence
tgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 63 - DNA, 329 bp, Artificial sequence
  Synthetic sequence
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcggt

SEQ ID NO: 64 - DNA, 329 bp, Artificial sequence
  Synthetic sequence
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcgtt

SEQ ID NO: 65 - DNA, 325 bp, Artificial sequence
  Synthetic sequence
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgg

SEQ ID NO: 66 - DNA, 326 bp, Artificial sequence
  Synthetic sequence
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgtt

SEQ ID NO: 67 - DNA, 280 bp, Artificial sequence
  Synthetic sequence
tggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 68 - DNA, 282 bp, Artificial sequence
  Synthetic sequence
tggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 69 - DNA, 280 bp, Artificial sequence
  Synthetic sequence
tggtcgaggtgagccccacgttctgcttcactctccccatctcccccccctccccacccccaattttgtatttatttattttttaattattttgtgcagcgatgggggcggggggggggggggcgcgcgccaggtggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 70 - DNA, 283 bp, Artificial sequence
  Synthetic sequence
tgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcggga

SEQ ID NO: 71 - DNA, 270 bp, Cricetulus griseus
tctctctttttttttttttttttttttttttttccaaaaggaggggagagggggtaaaaaaatgctgcactgtgcggctaggccggtgagtgagcggcgcggagccaatcagcgctcgccgttccgaaagttgccttttatggctcgagtggccgctgtggcgtcctataaaacccggcggcgcaacgcgcagccactgtcgagtccgcgtccacccgcgagcacaggcctttcgcagctctttcttcgccgctccacacccgccaccag

SEQ ID NO: 72 - DNA, 294 bp, Mus musculus
tcaatctcgctttctctctcgctttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtcgcgtccacccgcgagcacagcttctttgcagctccttcgttgccggtccacacccgccaccag

SEQ ID NO: 73 - DNA, 230 bp, Mus musculus
tcaatctcgctttctctctcgcttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtc

SEQ ID NO: 74 - DNA, 308 bp, Rattus norvegicus
acctcttcctcaactcacttctctctactctcacttttttttttcttcttcttttttttttttttttttttttttttttttgcaaaagaagggggtaaaaaaatgctgcactgtcgggcgaggccggtgagtgagcgagccggagccaatcagcgcccgccgttccgaaattgccttttatggctcgagtggccgctgtggcgtcctataaaacccggcggcgcaacgcgcgccactgtcgagtccgcgtccacccgcgagtacaacctccttgcagctcctccgtcccggtccacacccgccaccag

SEQ ID NO: 75 - DNA, 253 bp, Homo sapiens
gcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccgcggcggcgccctataaaacccagcggcgcgacgcgccaccaccgccgagtc

SEQ ID NO: 76 - DNA, 61 bp, Artificial sequence
  Synthetic sequence
ttgccttttatggctcgagtggccgctgtggcgtcctataaaacccggcggcgcaacgcgc

SEQ ID NO: 77 - DNA, 523 bp, Artificial sequence
  Synthetic sequence
atgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcag

SEQ ID NO: 78 - DNA, 573 bp, Mus musculus
cgaagaacaacgaggagaagatcctcaacttttccgcagccttttcaataatggggagaggttcgatgatgcagtggcagggtgacccacacttctccatttcccctgttctcccattttactcgggaagcagcattcaggtttctgggtcctggatgtccttggtgcacactccaaggactcctcgtccttaagttcatagtctgtattccctgagtcctatcctgggaaccatcacccggtcacctcctgagcggggcaatctcagctcccctccccctatcagttcggagcccacacgcttggtgcgtgcacatttcaaaaatgaggcgggtccaaagagagggaggaggggaaatgagagaggcccagctactcgcggctttacgggtgcacgtagctcaggcctctgcgcccttgagctaggactggataagcagggcgggaggcggggcgcgcgtcatcagctcccccccaccatccgggttcctataaatacggactgcagccctccctggtgctctctgctcctccctgttccagagtcggccgcatcttcttgtgcagtgccag

SEQ ID NO: 79 - DNA, 508 bp, Mus musculus
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 80 - DNA, 460 bp, Artificial sequence
  Synthetic sequence
ctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 81 - DNA, 466 bp, Homo sapiens
cggggttggggttgcgccttttccaaggcagccctgggtttgcgcagggacgcggctgctctgggcgtggttccgggaaacgcagcggcgccgaccctgggcctcgcacattcttcacgtccgttcgcagcgtcacccggatcttcgccgctacccttgtgggccccccggcgacgcttcctcgtccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtc

SEQ ID NO: 82 - DNA, 458 bp, Artificial sequence
  Synthetic sequence
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgagagcagcggccgggaaggggcggtgcgggaggcggggtgtggggcggtagtgtgggccctgttcctgcccgcgcggtgttccgcattctgcaagcctccggagcgcacgtc

SEQ ID NO: 83 - DNA, 1092 bp, Homo sapiens
aagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtca

SEQ ID NO: 84 - DNA, 215 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcag

SEQ ID NO: 85 - DNA, 753 bp, Artificial sequence
  Synthetic sequence
aaatgagtcttcggacctcgcgggggccgcttaagcggtggttagggtttgtctgacgcggggggagggggaaggaacgaaacactctcattcggaggcggctcggggtttggtcttggtggccacgggcacgcagaagagcgccgcgatcctcttaagcacccccccgccctccgtggaggcgggggtttggtcggcgggtggtaactggcgggccgctgactcgggcgggtcgcgcgccccagagtgtgaccttttcggtctgctcgcagacccccgggcggcgccgccgcggcggcgacgggctcgctgggtcctaggctccatggggaccgtatacgtggacaggctctggagcatccgcacgactgcggtgatattaccggagaccttctgcgggacgagccgggtcacgcggctgacgcggagcgtccgttgggcgacaaacaccaggacggggcacaggtacactatcttgtcacccggaggcgcgagggactgcaggagcttcagggagtggcgcagctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagcgacccgcttaa

SEQ ID NO: 86 - DNA, 270 bp, Artificial sequence
  Synthetic sequence
cagtgtggttttcaagaggaagcaaaaagcctctccacccaggcctggaatgtttccacccaatgtcgagcagtgtggttttgcaagaggaagcaaaaagcctctccacccaggcctggaatgtttccacccaatgtcgagcaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagg

SEQ ID NO: 87 - DNA, 149 bp, Artificial sequence
  Synthetic sequence
tcccgcccctaactccgcccagttccgcccattctccgccccatggctgactaattttttttatttatgcagaggccgaggccgcctcggcctctgagctattccagaagtagtgaggaggcttttttggaggtataggcttttgcaaa

SEQ ID NO: 88 - DNA, 128 bp, Artificial sequence
  Synthetic sequence
gttccgcccattctccgccccatggctgactaattttttttatttatgcagaggccgaggccgcctcggcctctgagctattccagaagtagtgaggaggcttttttggaggcctaggcttttgcaaa

SEQ ID NO: 89 - DNA, 660 bp, Artificial sequence
  Synthetic sequence
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 90 - DNA, 408 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 91 - DNA, 827 bp, Artificial sequence
  Synthetic sequence
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagtttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 92 - DNA, 827 bp, Artificial sequence
  Synthetic sequence
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 93 - DNA, 825 bp, Artificial sequence
  Synthetic sequence
gtaagtagaccaaggccttttattggctgcggtgttaaggcaagctgcctgtctatccctatctatctactatccacctggctctctagctccatactgcgtacggtgtttgttagcttagggtgatagcaagtagaacgctggtgatggttgctctctatcagtttagcgctggtgatggtggcctccttctccatttcttatatatatatgctggtgatggtccctcttccatggccgcggtgtgcttcggtgccgggtaccgtaacgtggtacagaaaaaggcctgacacgtacgcgtctctccctaggatgctatgtgtctgtagcaccggcggagcttgcgagctcgatgtccaagatagagtctccatgactgctcagatcgtctcctgtgttcacacaccagatattacaagcgacggccgccatgataagtccaaaaatgagcagaatacagaatattgtactcagaggctgcagccatcttggtggcctgctgtggtgctcttttcccgtggaggactccgtcagttcctgcgtgttgttgctcgtactgcgaagatctctcttgccccgtcctgaaaacctaggccctgacagaaaaaagggagagttaggagagggcacagaggattctgtctgtgtcaagggggcttccatgttgtttctttacctgagatctcttccaccagttgttttttatcagcaactgacaggtagtatatcaaaatgagtgcactgatgattattagcactgtatactttagatatcttctggtctctgtggacatctgttgatgataaaaaattatatttttttag

SEQ ID NO: 94 - DNA, 1246 bp, Artificial sequence
  Synthetic sequence
gtaaggttgcattgggctcggctatgggacggggatttggcccggtactttaatatgggtggggtcttatgggtagggggcttattaatataacgccccctacccatacatattgcgtcacgtaattagaagccccctaccacgccattggcgcccgcccatagcggtactttcggttctatacaagatggctaccgcggttttcgatcgctcccgggggtctcatttctatagctggaaagcatccgacccccatgatctgtgccttagaccccagggtacgtgcctggataggtgggcgacccctagcggctgcttgtatttttatatcagagatcgaaaatcacagccgcccgtaacagctgtcagggctatacaagatggcgaccgctactttcgatcgctttttcttccctcgatcctgcttccgaaacgcaacccacccccggggtatgtgccttagaccctatagatgccccccaggacgcaggaaaaattttagctcccctctataattttattcgagcgatcgaaatccgcggaccgcccgggtttttactttcgttttctcggtcgccgctcggctcggattccgagcagaaaaagggctagaaagctgcgctcacctgccgaaacgcgttgttcggatcatcccgggagggccagcgtagtctccgttgctgggttcggccgagggatcgagtcgagcgggcggcgggacgccgggaacgagagaggatcgggagcgggcgcccgggtggctcgggagcggccgggagacggtctgcagagctccagagctgcgtgtcctgacactgaacagttgggaaaaatactggatcttataatgacccaggggaaggggtccgagatcctcccagtgtccgagactgccaagagacactcctgttgaaaagcagctctaaaacgttttcctgctcatctctgccagacccccgcccactgacagagctcaattgatagcagatgtcctctttggaaggacacacgcttccacaaacaccgttcctcactgaggtgcattgtctgggagggaaggtcaccttcttgttcattgtggacggtgtgcggcccaggcctcggacgaccctggcccgggcttccttcttcctgatccaggtagattgacgtgcggacatcgcgaacgaccgcagtcttcctgatctttgaatgactcgagtacatgagcgcacctttcgagactgatctctcttgttctccatag

SEQ ID NO: 95 - DNA, 1246 bp, Artificial sequence
  Synthetic sequence
gtaaggttgcattgggctcggctatgggacggggatttggcccggtactttaatatgggtggggtcttatgggtagggggcttattaatataacgccccctacccatacatattgcgtcacgtaattagaagccccctaccacgccattggcgcccgcccatagcggtactttcggttctatacaagatggctaccgcggttttcgatcgctcccgggggtcacatttctatagctggaaagcatccgacccccatgatctgtgccttagaccccagggtacgtgcctggataggtgggcgacccctagcggctgcttgtatttttatatcagagatcgaaaatcacagccgcccgtaacagctgtcagggctatacaagatggcgaccgctactttcgatcgctttttcttccctcgatcctgcttccgaaacgcaacccacccccggggtatgtgccttagaccctatagatgccccccaggacgcaggaaaaattttagctcccctctataattttattcgagcgatcgaaatccgcggaccgcccgggtttttactttcgttttctcggtcgccgctcggctcggattccgagcagaaaaagggctagaaagctgcgctctcctgccgaaacgcgttgttcggatcatcccgggagggccagcgtagtctccgttgctgggttcggccgagggatcgagtcgagcgggcggcgggacgccgggaacgagagaggatcgggagcgggcgcccgggtggctcgggagcggccgggagagggtctgcagagctccagagctgcgtgtcctgacactgaacagttgggaaaaatactggatcttataatgacccaggggaaggggtccgagatcctcccagtgtccgagactgccaagagacactcctgttgaaaagcagctctaaaacgttttcctgctcatctctgccagacccccgcccactgacagagctcaattgatagcagatgtcctctttggaaggacacacgcttccacaaacaccgttcctcactgaggtgcattgtctgggagggaaggtcaccttcttgttcattgtggacggtgtgcggcccaggcctcggacgaccctggcccgggcttccttcttcctgatccaggtagattgacgtgcggacatcgcgaacgaccgcagtgttcctgatctttgaatgactcgagtacatgagcgcacctttcgagactgatctctcttgttctccatag

SEQ ID NO: 96 - DNA, 114 bp, Artificial sequence
  Synthetic sequence
gtacgtgtcggggtttgtgccccccctttttttttaataaaattgtattaatgttatatacatatctcctgtatgtgacccatgtgcttatgactctatttctcatgtgtttag

SEQ ID NO: 97 - DNA, 170 bp, Artificial sequence
  Synthetic sequence
gtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacag

SEQ ID NO: 98 - DNA, 122 bp, Mus musculus
gtgagtgtctcagttattcacatcatgactcttctaactatcttatctcctctacctgtctctgtctttcatattcacccacacagaacacttgagttatacaaaccactcttatattccag

SEQ ID NO: 99 - DNA, 174 bp, Pan troglodytes
gtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacag

SEQ ID NO: 100 - DNA, 97 bp, Mus musculus
gtaagtttctgtttccatttcctctcttgtgacacatttcatgactctgcatttacataacccctgactcatggtcttcccactcttgttctctcag

SEQ ID NO: 101 - DNA, 856 bp, Pan troglodytes
gtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggtagttgtcgctcagtcgtcactgccgccagcagagggagacataagtacaccaggctcaaccacactgtcttcatggatgtttgcaggtagagaccacacgcggcacttcaccagagag

SEQ ID NO: 102 - DNA, 181 bp, Artificial sequence
  Synthetic sequence
gtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacag

SEQ ID NO: 103 - DNA, 213 bp, Artificial sequence
  Synthetic sequence
gtaagtctgttgacatgtatgtgatgtatactaatctgcatgggacgtggatttacttgtgtatgtcagatagagtaaagattaactcttgcatgtgagcggggcatcgagatagcgataaatgagtcaggaggacggatacttatatgtgttgttatcctcctctacagagcctctgctaaccatgttcatgccttcttctttttcctacag

SEQ ID NO: 104 - DNA, 841 bp, Artificial sequence
  Synthetic sequence
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagaagcctctgctaaccatgttcatgccttcttctttttcctacag

SEQ ID NO: 105 - DNA, 850 bp, Artificial sequence
  Synthetic sequence
gtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacag

SEQ ID NO: 106 - DNA, 943 bp, Cricetulus griseus
gtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaag

SEQ ID NO: 107 - DNA, 923 bp, Homo sapiens
gtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 108 - DNA, 943 bp, Homo sapiens
gtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcag

SEQ ID NO: 109 - DNA, 943 bp, Homo sapiens
gtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 110 - DNA, 938 bp, Homo sapiens
gtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcag

SEQ ID NO: 111 - DNA, 948 bp, Mus musculus
gtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttag

SEQ ID NO: 112 - DNA, 944 bp, Rattus norvegicus
gtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaag

SEQ ID NO: 113 - DNA, 1133 bp, Artificial sequence
  Synthetic sequence
gtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacag

SEQ ID NO: 114 - DNA, 1018 bp, Artificial sequence
  Synthetic sequence
gtgagtgaccccggagcggcggtgctcggggccggagacggtacctcggggctgcgggacgtgtcggtggcggtccgcggaggccggcctgggaggagacatggctgccggggcggcgggacgtggacggacggggcggctggcgccatgtctgcgcgtcgggctgtggcctcggcacggcggccgttgtcccctcggcggacggtgctgatttggcagtgggcacagccaggcctctggccgccctcgggcgtgggatcgctggtcccgtccccggcggagggccagcgtccctttacgaggtgacagccgggtgggcggtcttccgtttgcacatccgcgtcccctgtggccggcctccgcgcgtcacgtcgctgctgtaggaccccctcctgaacggtgacgtgctccctgctaaccaaatggattccgaaggtagcctgggcaagggctctcgcatcccgccatgtggaacccgctggctttgggtggcgcaaagcgtgtcccatgccgagcgtctggaggttctgtgcctccacacgtgtggacccatcgagttgtcatgagtagtgtcctgctgaggttcccacgcacttctaggcactgcttgcttggctgtgaagctggggtggcaggcgcagttttgttgcctgtggatgcgttggaagattgggggcctttggttattgcggtggtgactgtctttgagatagggtttcacgtagcccaggcttgctcaggtggttagttcagggtttgtttagttagggctggacttctgacgtgctggctgtggactcttgatctgtatgctaacgaggtgcttgggcttgcaggctcgagtcaccgcggactcactgttccttatgaatgacaaccgaggctccatcttgggctgacggtcgtggttgtagtggctgtgtgcgcactggagtgttgtgtgggcaggccacggccacgcgtgggaaacgacatgctgctgcctgcagtttgctcagctgcccctcccccatcccag

SEQ ID NO: 115 - DNA, 1018 bp, Artificial sequence
  Synthetic sequence
gtgagtgaccccggagcggcggtgctcggggccggagtcggtacctcggggctgcgggacgtgtcggtggcggtccgcggaggccggcctgggaggagacatggctgccggggcggcgggacgtggacggacggggcggctggcgccatgtctgcgcgtcgggctgtggcctcggcacggcggccgttgtcccctcggcggacggtgctgatttggcagtgggcacagccaggcctctggccgccctcgggcgtgggatcgctggtcccgtccccggcggagggccagcgtccctttacgaggtgacagccgggtgggcggacttccgtttgcacatccgcgtcccctgtggccggcctccgcgcgtcacgtcgctgctgtaggaccccctcctgaacggtgacgtgctccctgctaaccaaatggattccgaaggtagcctgggcaagggctctcgcatcccgccatgtggaacccgctggctttgggtggcgcaaagcgtgtcccatgccgagcgtctggaggttctgtgcctccacacgtgtggacccatcgagttgtcatgagtagtgtcctgctgaggttcccacgcacttctaggcactgcttgcttggctgtgaagctggggtggcaggcgcagttttgttgcctgtggatgcgttggaagattgggggcctttggttattgcggtggtgactgtctttgagatagggtttcacgtagcccaggcttgctcaggtggttagttcagggtttgtttagttagggctggacttctgacgtgctggctgtggactcttgatctgtatgctaacgaggtgcttgggcttgcaggctcgagtcaccgcggactcactgttccttatgaatgacaaccgaggctccatcttgggctgacggtcgtggttgtagtggctgtgtgcgcactggagtgttgtgtgggcaggccacggccacgcgtgggaaacgacatgctgctgcctgcagtttgctcagctgcccctcccccatcccag

SEQ ID NO: 116 - DNA, 1028 bp, Artificial sequence
  Synthetic sequence
gtgagtaaccctgcctcgctggtgccccggagcggcggcggggcctccgcggggcctacgctgcctagcctgggacgctggggccccccgtgccaggaggagacgtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccag

SEQ ID NO: 117 - DNA, 1027 bp, Artificial sequence
  Synthetic sequence
gtgagtaaccctgcctcgctggtgccccggagcggcggcggggcctccgcggggcctacgctgcctagcctgggacgctggggccccccgtgccaggaggagaggtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccag

SEQ ID NO: 118 - DNA, 935 bp, Artificial sequence
  Synthetic sequence
gtgagtctcctcggctccgctagactcggggaccgagacgaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtctctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtcttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacag

SEQ ID NO: 119 - DNA, 935 bp, Artificial sequence
  Synthetic sequence
gtgagtctcctcggctccgctagactcggggaccgagaggaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtgtctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtgttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacag

SEQ ID NO: 120 - DNA, 874 bp, Artificial sequence
  Synthetic sequence
gtgagtgtccgcggcgcggcaagacttggggactgagacgagtcttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggagacctctagtgagctgagcgtcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtctcagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacag

SEQ ID NO: 121 - DNA, 874 bp, Artificial sequence
  Synthetic sequence
gtgagtgtccgcggcgcggcaagacttggggactgtgacgagacttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggtgacctctagtgagctgagcctcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtcacagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacag

SEQ ID NO: 122 - DNA, 971 bp, Artificial sequence
  Synthetic sequence
gtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctag

SEQ ID NO: 123 - DNA, 971 bp, Artificial sequence; identical to SEQ ID NO: 122
  Synthetic sequence

SEQ ID NO: 124 - DNA, 963 bp, Artificial sequence
  Synthetic sequence
gtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctag

SEQ ID NO: 125 - DNA, 971 bp, Artificial sequence
  Synthetic sequence
gtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcgccaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctag

SEQ ID NO: 126 - DNA, 956 bp, Cricetulus griseus
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggagacctggcttcctgccgtggggccgcctccggaccagcgtttgcctcttatggtaataacgcggccggcctgggcttcatttgtcccctgagtttgggcgcgcgccccctggcggcccgagaccgcggcttgccggaagtgggcagggcggcaacggctgcgcctagtggcccgccagtgaccgcgaccctcttttgtgccctgatatag

SEQ ID NO: 127 - DNA, 956 bp, Cricetulus griseus
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatag

SEQ ID NO: 128 - DNA, 959 bp, Mus musculus
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggagctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatag

SEQ ID NO: 129 - DNA, 959 bp, Mus musculus
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatag

SEQ ID NO: 130 - DNA, 929 bp, Rattus norvegicus
gtaagcagggacgtcgggcccagcgggccccaactttaccttggccactacctcgctgcaggatcgtgaggaacactcagaagggacaccgtagaggggtggagcgtggtaccgggccgcggagcagctggcaaagcttaactttcccggcccctagggtgtagagtgtttgcagtcgtattcccgcggtgtggacactcgtgggtacgctcctgcttggtgcgcggggcttggggacacactagagtcgcggtgtgggcatttggagagccggtgcggctgcgggtgttaagccgcatctgtccaccttgaggggcaacagtattggggtcaggcgttacaatcacgctttgatggcctatgggtctttgtccaaaccggttttgccattcggcttggcgggcgcggcggggccgctcggccgggtgggggctgggatgccattgcgcgtgcgcgctctatcactgggcattggggccgtgcgcgctggggagggaactcttcctctccccctcttccgagttaagagttgcgcgtgcgtattgagactaggagcgcggccgccccgggttgggcgagggcgggccgtccaccggaaggggcggggtcgtagcggctaggcgcctgctcgcgcttcctgctgggtgtggtcgcctcccgcgcgcgcactagccgcccgtcgcctcagtgtaggcgggcctgtgcccgtttggggaggggcggaggcctggcttcctgccgtgggtccgcctccgggccagcgtttgccttttatggtaataatgcggctgtcctgcgcttcctttgtcccctgagcttgggcgcgcccctggcggctcgaggccgcggctcgccggaagtgggcagggcggcagcggctgctcttggcggctccgcggtgaccatagccctcttttgtgccttgatag

SEQ ID NO: 131 - DNA, 767 bp, Homo sapiens
gtaagcccggccagccgaccggggcatgcggccgcggcccttcgcccgtgcagagccgccgtctgggccgcagcggggggcgcatggggcggaaccggaccgccgtggggggcgcgggagaagcccctgggcctccggagatgggggacaccccacgccagttcgcaggcgcgaggccgcgctcgggcgggcgcgctccgggggtgccgctctcggggcgggggcaaccggcggggtctttgtctgagccgggctcttgccaatggggatcgcacggtgggcgcggcgtagcccccgtcaggcccggtgggggctggggcgccatgcgcgtgcgcgctggtcctttgggcgctaactgcgtgcgcgctgggaattggcgctaattgcgcgtgcgcgctgggactcaatggcgctaatcgcgcgtgcgttctggggcccgggcgcttgcgccacttcctgcccgagccgctggcgcccgagggtgtggccgctgcgtgcgcgcgcgcgacccggtcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcgggggcgacttcggctcacagcgcgcccggctattctcgcag

SEQ ID NO: 132 - DNA, 1005 bp, Artificial sequence
  Synthetic sequence
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatagttcgccagcctctgctaaccatgttcatgccttcttctttttcctacag

SEQ ID NO: 133 - DNA, 1008 bp, Artificial sequence
  Synthetic sequence
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatagttcgccagcctctgctaaccatgttcatgccttcttctttttcctacag

SEQ ID NO: 134 - DNA, 978 bp, Artificial sequence
  Synthetic sequence
gtaagcagggacgtcgggcccagcgggccccaactttaccttggccactacctcgctgcaggatcgtgaggaacactcagaagggacaccgtagaggggtggagcgtggtaccgggccgcggagcagctggcaaagcttaactttcccggcccctagggtgtagagtgtttgcagtcgtattcccgcggtgtggacactcgtgggtacgctcctgcttggtgcgcggggcttggggacacactagagtcgcggtgtgggcatttggagagccggtgcggctgcgggtgttaagccgcatctgtccaccttgaggggcaacagtattggggtcaggcgttacaatcacgctttgatggcctatgggtctttgtccaaaccggttttgccattcggcttggcgggcgcggcggggccgctcggccgggtgggggctgggatgccattgcgcgtgcgcgctctatcactgggcattggggccgtgcgcgctggggagggaactcttcctctccccctcttccgagttaagagttgcgcgtgcgtattgagactaggagcgcggccgccccgggttgggcgagggcgggccgtccaccggaaggggcggggtcgtagcggctaggcgcctgctcgcgcttcctgctgggtgtggtcgcctcccgcgcgcgcactagccgcccgtcgcctcagtgtaggcgggcctgtgcccgtttggggaggggcggaggcctggcttcctgccgtgggtccgcctccgggccagcgtttgccttttatggtaataatgcggctgtcctgcgcttcctttgtcccctgagcttgggcgcgcccctggcggctcgaggccgcggctcgccggaagtgggcagggcggcagcggctgctcttggcggctccgcggtgaccatagccctcttttgtgccttgatagttcgccagcctctgctaaccatgttcatgccttcttctttttcctacag

SEQ ID NO: 135 - DNA, 833 bp, Artificial sequence
  Synthetic sequence
gtaagcccggccagccgaccggggcatgcggccgcggcccttcgcccgtgcagagccgccgtctgggccgcagcggggggcgcatggggcggaaccggaccgccgtggggggcgcgggagaagcccctgggcctccggagatgggggacaccccacgccagttcgcaggcgcgaggccgcgctcgggcgggcgcgctccgggggtgccgctctcggggcgggggcaaccggcggggtctttgtctgagccgggctcttgccaatggggatcgcacggtgggcgcggcgtagcccccgtcaggcccggtgggggctggggcgccatgcgcgtgcgcgctggtcctttgggcgctaactgcgtgcgcgctgggaattggcgctaattgcgcgtgcgcgctgggactcaatggcgctaatcgcgcgtgcgttctggggcccgggcgcttgcgccacttcctgcccgagccgctggcgcccgagggtgtggccgctgcgtgcgcgcgcgcgacccggtcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcggcagcggctgctcttggcggccccgaggtgactatagccttcttttgtgtcttgatagttcgccagcctctgctaaccatgttcatgccttcttctttttcctacag

SEQ ID NO: 136 - DNA, 240 bp, Artificial sequence
  Synthetic sequence
gtaaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcag

SEQ ID NO: 137 - DNA, 240 bp, Artificial sequence
  Synthetic sequence
gtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcag

SEQ ID NO: 138 - DNA, 240 bp, Mus musculus
gtgaaaatcgcggagtgggccgcaggaggccggggacagtcggaaactgggaaggggagtgggcactgtacgggtctagggatgctggtgcgaagtgtgcaagccggacccaggctccgcattgcaggggggggatgatggaggacgtgatggggcgcacggcgggaatggaggcggggtgggggaggggactgcctggtgtccttcgggccacgctaatctcattttcttctcctgcag

SEQ ID NO: 139 - DNA, 188 bp, Artificial sequence
  Synthetic sequence
gtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 140 - DNA, 512 bp, Artificial sequence
  Synthetic sequence
ctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 141 - DNA, 66 bp, Artificial sequence
  Synthetic sequence
gtaaatataaaatttttaagtgtataatgtgttaaactactgattctaattgtttgtgtattttag

SEQ ID NO: 142 - DNA, 530 bp, Pan troglodytes
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccg

SEQ ID NO: 143 - DNA, 1388 bp, Artificial sequence
  Synthetic sequence
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggaggg

SEQ ID NO: 144 - DNA, 1501 bp, Artificial sequence
  Synthetic sequence
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacag

SEQ ID NO: 145 - DNA, 1507 bp, Artificial sequence
  Synthetic sequence
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggtagttgtcgctcagtcgtcactgccgccagcagagggagacataagtacaccaggctcaaccacactgtcttcatggatgtttgcaggtagagaccacacgcggcacttcaccagagag

SEQ ID NO: 146 - DNA, 833 bp, Artificial sequence
  Synthetic sequence
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggaacctgaagtcctttgaagatatcaccaaggagtgtgataagaaccccgggaaggacattctgcaagaacttggtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacag

SEQ ID NO: 147 - DNA, 846 bp, Artificial sequence
  Synthetic sequence
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacag

SEQ ID NO: 148 - DNA, 1029 bp, Artificial sequence
  Synthetic sequence
ggtctctctctccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggtagcttccttcttctttttcctagaagctcagaataaacgctcaactttggccgccaccagagacc

SEQ ID NO: 149 - DNA, 1039 bp, Artificial sequence
  Synthetic sequence
ggtctctctctccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccaccagagacc

SEQ ID NO: 150 - DNA, 1599 bp, Artificial sequence
  Synthetic sequence
ggtctctctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagaagcctctgctaaccatgttcatgccttcttctttttcctacagctcctgggcaacgtgctggttattgtgctgtctcatcattttggcaaagaattccgtctcaggggacagaccaccaataattcaaagcaagccgccaccagagacc

SEQ ID NO: 151 - DNA, 1578 bp, Artificial sequence
  Synthetic sequence
ggtctctctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagaagcctctgctaaccatgttcatgccttcttctttttcctacagctcctgggcaacgtgctggtagcttccttcttctttttcctagaagctcagaataaacgctcaactttggccgccaccagagacc

SEQ ID NO: 152 - DNA, 1039 bp, Artificial sequence
  Synthetic sequence
ggtctctctctccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagactccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccaccagagacc

SEQ ID NO: 153 - DNA, 1600 bp, Artificial sequence
  Synthetic sequence
ggtctctctctccaacattaccgccatgttgacttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacagctcctgggcaacgtgctggttattgtgctgtctcatcattttggcaaagaattgccaccagagacc

SEQ ID NO: 154 - DNA, 1687 bp, Artificial sequence
  Synthetic sequence
ggtctctctctccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagactccattcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacagctcctgggcaacgtgctggttattgtgctgtctcatcattttggcaaagaattgccaccagagacc

SEQ ID NO: 155 - DNA, 1106 bp, Artificial sequence
  Synthetic sequence
ggtctctctctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagactgcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccagcgtctcaggggacacccaagctgtctagagccgccaccagagacc

SEQ ID NO: 156 - DNA, 896 bp, Artificial sequence
  Synthetic sequence
ggtctctctctccaacattaccgccatgttgacttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggaacctgaagtcctttgaagatatcaccaaggagtgtgataagaaccccgggaaggacattctgcaagaacttggtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacagttaagcagattaaggccgccaccagagacc

SEQ ID NO: 157 - DNA, 948 bp, Artificial sequence
  Synthetic sequence
ggtctctctctccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagactccatagctccatagaaggaaccgggaacctgaagtcctttgaagatatcaccaaggagtgtgataagaaccccgggaaggacattctgcaagaacttggtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacagttaagcagattaaggccgccaccagagacc

SEQ ID NO: 158 - DNA, 913 bp, Artificial sequence
  Synthetic sequence
ggtctctctctgaattcgtttatcggccaccgaggccaagatctggccgccaattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagactccatatcgccgatcaggcatccgtcaacgcccacggccgtcacttggataagaaccgtgtctacccatcagacaagtaagtttctgtttccatttcctctcttgtgacacatttcatgactctgcatttacataacccctgactcatggtcttcccactcttgttctctcagggtgccagctcagcttccttcttctttttcctagaagctcagaataaacgctcaactttggccgccaccagagacc

SEQ ID NO: 159 - DNA, 623 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcgtctcaggggacacccaagctgtctagagccgccacc

SEQ ID NO: 160 - DNA, 1695 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctcaggggacacccaagctgtctagagccgccacc

SEQ ID NO: 161 - DNA, 870 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagcgtctcaggggacacccaagctgtctagagccgccacc

SEQ ID NO: 162 - DNA, 1937 bp, Artificial sequence
  Synthetic sequence
actacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcaggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcgccaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctcaggggacacccaagctgtctagagccgccacc

SEQ ID NO: 163 - DNA, 1516 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgcgtctcaggggacacccaagctgtctagagccgccacc

SEQ ID NO: 164 - DNA, 1516 bp, Artificial sequence; identical to SEQ ID NO: 163
  Synthetic sequence

SEQ ID NO: 165 - DNA, 1133 bp, Artificial sequence
  Synthetic sequence
actacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtaaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctccgtctcaggggacacccaagctgtctagagccgccacc

SEQ ID NO: 166 - DNA, 534 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcgtctcaggggacacccaagctgtctagagccgccacc

SEQ ID NO: 167 - DNA, 1516 bp, Artificial sequence; identical to SEQ ID NO: 163
  Synthetic sequence

SEQ ID NO: 168 - DNA, 878 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggacacccaagctgtctagagccgccacc

SEQ ID NO: 169 - DNA, 1489 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggacacccaagctgtctagagccgccacc

SEQ ID NO: 170 - DNA, 1516 bp, Artificial sequence; identical to SEQ ID NO: 163
  Synthetic sequence

SEQ ID NO: 171 - DNA, 1516 bp, Artificial sequence; identical to SEQ ID NO: 163
  Synthetic sequence

SEQ ID NO: 172 - DNA, 558 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatccgtctcaggggacacccaagctgtctagagccgccacc

SEQ ID NO: 173 - DNA, 1133 bp, Artificial sequence; identical to SEQ ID NO: 165
  Synthetic sequence

SEQ ID NO: 174 - DNA, 361 bp, Artificial sequence
  Synthetic sequence
ggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatcgctgactaattttttttatttatgcagaggccgaggccgcctcggcctctgagctattccagaagtagtgaggaggcttttttggaggcctaggcttttgcaaaaagcttcgtctcaggggacacccaagctgtctagagccgccacc

SEQ ID NO: 175 - DNA, 1469 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaggggacacccaagctgtctagagccgccacc

SEQ ID NO: 176 - DNA, 1062 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggggacacccaagctgtctagagccgccacc

SEQ ID NO: 177 - DNA, 1516 bp, Artificial sequence; identical to SEQ ID NO: 163
  Synthetic sequence

SEQ ID NO: 178 - DNA, 1062 bp, Artificial sequence; identical to SEQ ID NO: 176
  Synthetic sequence

SEQ ID NO: 179 - DNA, 1080 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggacacccaagctgtctagagccgccacc

SEQ ID NO: 180 - DNA, 1043 bp, Artificial sequence
  Synthetic sequence
caacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcgtctcaggggctctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggggacacccaagctgtctagagccgccacc

SEQ ID NO: 181 - DNA, 1076 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggggacacccaagctgtctagagccgccacc

SEQ ID NO: 182 - DNA, 1080 bp, Artificial sequence; identical to SEQ ID NO: 179
  Synthetic sequence

SEQ ID NO: 183 - DNA, 1043 bp, Artificial sequence; identical to SEQ ID NO: 180
  Synthetic sequence

SEQ ID NO: 184 - DNA, 697 bp, Artificial sequence
  Synthetic sequence
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctgtagacgccatccacgctgttttgacctccatagaagacaccgggaccgatccagcctccggggacacccaagctgtctagagccgccacc

SEQ ID NO: 185 - DNA, 1670 bp, Artificial sequence
  Synthetic sequence
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaggggacacccaagctgtctagagccgccacc

SEQ ID NO: 186 - DNA, 1469 bp, Artificial sequence; identical to SEQ ID NO: 175
  Synthetic sequence

SEQ ID NO: 187 - DNA, 1311 bp, Artificial sequence
  Synthetic sequence
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggaccgaagaacaacgaggagaagatcctcaacttttccgcagccttttcaataatggggagaggttcgatgatgcagtggcagggtgacccacacttctccatttcccctgttctcccattttactcgggaagcagcattcaggtttctgggtcctggatgtccttggtgcacactccaaggactcctcgtccttaagttcatagtctgtattccctgagtcctatcctgggaaccatcacccggtcacctcctgagcggggcaatctcagctcccctccccctatcagttcggagcccacacgcttggtgcgtgcacatttcaaaaatgaggcgggtccaaagagagggaggaggggaaatgagagaggcccagctactcgcggctttacgggtgcacgtagctcaggcctctgcgcccttgagctaggactggataagcagggcgggaggcggggcgcgcgtcatcagctcccccccaccatccgggttcctataaatacggactgcagccctccctggtgctctctgctcctccctgttccagagtcggccgcatcttcttgtgcagtgccaggtgaaaatcgcggagtgggccgcaggaggccggggacagtcggaaactgggaaggggagtgggcactgtacgggtctagggatgctggtgcgaagtgtgcaagccggacccaggctccgcattgcaggggggggatgatggaggacgtgatggggcgcacggcgggaatggaggcggggtgggggaggggactgcctggtgtccttcgggccacgctaatctcattttcttctcctgcagcctcgtcccgtagacaaacgtctcaggggacacccaagctgtctagagccgccacc

SEQ ID NO: 188 - DNA, 1755 bp, Cricetulus griseus
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggactctctctttttttttttttttttttttttttttccaaaaggaggggagagggggtaaaaaaatgctgcactgtgcggctaggccggtgagtgagcggcgcggagccaatcagcgctcgccgttccgaaagttgccttttatggctcgagtggccgctgtggcgtcctataaaacccggcggcgcaacgcgcagccactgtcgagtccgcgtccacccgcgagcacaggcctttcgcagctctttcttcgccgctccacacccgccaccaggtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatagttcgccagcctctgctaaccatgttcatgccttcttctttttcctacagcgtctcaggggacacccaagctgtctagagccgccacc

SEQ ID NO: 189 - DNA, 1547 bp, Artificial sequence
  Synthetic sequence
tatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagcctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggtcgtctcaggggacacccaagctgtctagagccgccacc

SEQ ID NO: 190 - DNA, 1797 bp, Mus musculus
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggacctcttcatcctcttcctcaatctcgctttctctctcgcttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtcgcgtccacccgcgagcacagcttctttgcagctccttcgttgccggtccacacccgccaccaggtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatagttcgccagcctctgctaaccatgttcatgccttcttctttttcctacagcgtctcaggggacacccaagctgtctagagccgccacc

SEQ ID NO: 191 - DNA, 769 bp, Artificial sequence
  Synthetic sequence
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagactccatccacgctgttttgacctccatagaagataccgggaccgatccagcctccgcggccgggaacggtgcattggaacgcggattccccgtgccaagagtgactcaccgtccttgacacggccgcggggacacccaagctgtctagagccgccacc

SEQ ID NO: 192 - DNA, 280 bp, Homo sapiens
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 193 - DNA, 280 bp, Homo sapiens
tgtatactctatattatactctatgttatactctgtaatcctactcaataaacgtgtcacgcctgtgaaaccgtactaagtctcccgtgacttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 194 - DNA, 328 bp, Homo sapiens
actattgtatatatatatcagttactgttatggatcccacgtcactattgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 195 - DNA, 328 bp, Homo sapiens
actattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 196 - DNA, 343 bp, Mus musculus
atccacaagcccagctccccacccatcaccatggacaatgtttttttactaacacttggacaatgatggatacttttttactaacacttggacaatgatgatgatacactcctcacctgcccacttagacacaattactaacaccacaccccctcttttatttctctgtacttaatgttttctgaataaagtgatcctattgtacccacattaaagacttctttaactctttatggttcacaggacccgagatgaacatagatattgttacagcagcggcctccatgtcaggtataactactgcctcacacagcgccctgccaatcagaagaccaaacacccc

SEQ ID NO: 197 - DNA, 331 bp, Mus musculus
atccacaagcccagctccccacccatcaccatggacaatgtttttttactaacacttggacaatgatggatacttttttactaacacttggacaatgatgatgatacactcctcacttgcccacttagacacaattactaacaccacaccccctcttttatttctctgtacttaatgttttctgaataaagtgatcctattgtacccacattaaagacttctttaactctttatggttcacaggacccgagatgaacatagatattgttacagcagcggcctccatgtcaggtataactactgcctcacacagcgccctgccaatcagaag

SEQ ID NO: 198 - DNA, 270 bp, Cricetulus griseus
atattacccctaacacctgccaccccagtcttaatcagtggtggaagaacggtctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgagacccattaaaa

SEQ ID NO: 199 - DNA, 292 bp, Cricetulus griseus
atattacccctaacacctgccaccccagtcttaatcagtggtggaagaacggtgtcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaatttttagacccattaaaatacaagtttaatgagaagtctg

SEQ ID NO: 200 - DNA, 573 bp, Homo sapiens
attatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgggttgcatagaaagct

SEQ ID NO: 201 - DNA, 280 bp, Homo sapiens
attatccctaatacctgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgacacccattaaaaaa

SEQ ID NO: 202 - DNA, 186 bp, Homo sapiens
gcatatactgagattgagattaacttcctgtgaaacccagtgtcttagacaactgtggcttgagcaccacctgctggtattcattacaaacttgctcactacaataaatgaattttaagctttaagatgaagtggcatttcttttaacagttactatgttggaattggttacaaattttggagtgg

SEQ ID NO: 203 - DNA, 186 bp, Homo sapiens
gcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtgg

SEQ ID NO: 204 - DNA, 337 bp, Homo sapiens
atattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaa

SEQ ID NO: 205 - DNA, 185 bp, Bos taurus
ttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattggcaagacaatagcaggc

SEQ ID NO: 206 - DNA, 251 bp, Bos taurus
ttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggg

SEQ ID NO: 207 - DNA, 99 bp, Bos taurus
ttgccagccatctgttgtttgcccctcccccgtgccttccttgaccctggaaggtgccactcccactgtcctttcctaataaaatgaggaaattgcatc

SEQ ID NO: 208 - DNA, 479 bp, Homo sapiens
acgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 209 - DNA, 202 bp, Homo sapiens
ctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttgggaagaaacctgtagggcctgc

SEQ ID NO: 210 - DNA, 210 bp, Homo sapiens
ctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 211 - DNA, 210 bp, Homo sapiens
ctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggagatcagtgcatttaaaacataaagaaa

SEQ ID NO: 212 - DNA, 387 bp, Artificial sequence
  Synthetic sequence
tggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 213 - DNA, 527 bp, Artificial sequence
  Synthetic sequence
ttcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 214 - DNA, 387 bp, Artificial sequence
  Synthetic sequence
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 215 - DNA, 387 bp, Artificial sequence
  Synthetic sequence
aggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 216 - DNA, 99 bp, Artificial sequence
  Synthetic sequence
gacctctggctaataaaggaaatttattttcattgcaatagtgtgttggaattttttgtgtctctcactcggaaggacatatgggagggcaaatcattt

SEQ ID NO: 217 - DNA, 155 bp, Homo sapiens
gtgcgacggccggcaagcccccgctccccgggctctcgcggtcgcacgaggatgcttggcacgtaccccctgtacatacttcccgggcgcccagcatggaaataaagcacccagcgctgccctgggcccctgcgagactgtgatggttctttcca

SEQ ID NO: 218 - DNA, 860 bp, Homo sapiens
agggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcacctgtggtttctctctttcctcatttaataattattatctgttgttttaccaactactcaatttctcttataagggactaaatatgtagtcatcctaaggcgcataaccatttataaaaatcatccttcattctattttaccctatcatcctctgcaagacagtcctccctcaaacccacaagccttctgtcctcacagtcccctgggccatggtaggagagacttgcttccttgttttcccctcctcagcaagccctcatagtcctttttaagggtgacaggtcttacagtcatatatcctttgattcaattccctgagaatcaaccaaagcaaatttttcaaaagaagaaacctgctataaagagaatcattcattgcaacatgatataaaataacaacacaataaaagcaattaaataaacaaacaatagggaaatgtttaagttcatcatggtacttagacttaatggaatgtcatgccttatttacatttttaaacaggtactgagggactcctgtctgccaagggccgtattgagtactttccacaacctaatttaatccacactatactgtgagattaaaaacattcattaaaatgttgcaaaggttctataaagctgagagacaaatatattctataactcagcaatcccacttcta

SEQ ID NO: 219 - DNA, 983 bp, Homo sapiens
gtgcgacggccggcaagcccccgctccccgggctctcgcggtcgcacgaggatgcttggcacgtaccccctgtacatacttcccgggcgcccagcatggaaataaagcacccagcgctgccctgggcccctgcgagactgtgatggttctttccacgggtcaggccgagtctgaggcctgagtggcatgagggaggcagagcgggtcccactgtccccacactggcccaggctgtgcaggtgtgcctgggccgcctagggtggggctcagccaggggctgccctcggcagggtgggggatttgccagcgtggccctccctccagcagcacctgccctgggctgggccacgggaagccctaggagcccctggggacagacacacagcccctgcctctgtaggagactgtcctgttctgtgagcgccctgtcctccgacctccatgcccactcgggggcatgcctagtccatgtgcgtagggacaggccctccctcacccatctacccccacggcactaacccctggctgccctgcccagcctcgcacccgcatggggacacaaccgactccggggacatgcactctcgggccctgtggagggactggtgcagatgcccacacacacactcagcccagacccgttcaacaaaccccgcactgaggttggccggccacacggccaccacacacacacgtgcacgcctcacacacggagcctcacccgggcgaactgcacagcacccagaccagagcaaggtcctcgcacacgtgaacactcctcggacacaggcccccacgagccccacgcggcacctcaaggcccacgagcctctcggcagcttctccacatgctgacctgctcagacaaacccagccctcctctcacaagggtgcccctgcagccgccacacacacacaggggatcacacaccacgtcacgtccctggccctggcccacttcccagtgccgcccttccctgcag

SEQ ID NO: 220 - DNA, 223 bp, Simian virus 40
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaa

SEQ ID NO: 221 - DNA, 222 bp, Simian virus 40
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 222 - DNA, 129 bp, Simian virus 40
aacttgtttattgcagcttataatggttacaaataaagcaatagcatcacaaatttcacaaataaagcatttttttcactgcattctagttgtggtttgtccaaactcatcaatgtatcttatcatgtc

SEQ ID NO: 223 - DNA, 249 bp, Simian virus 40
gacatgataagatacattgatgagtttggacaaaccacaactagaatgcagtgaaaaaaatgctttatttgtgaaatttgtgatgctattgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 224 - DNA, 271 bp, Herpes simplex virus
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatag

SEQ ID NO: 225 - DNA, 271 bp, Herpes simplex virus
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatag

SEQ ID NO: 226 - DNA, 194 bp, Herpes simplex virus
gcggccgcgtcgaaattcacgcgtaagcttctcgaccgggagatgggggaggctaactgaaacacggaaggagacaataccggaaggaacccgcgctatgacggcaataaaaagacagaataaaacgcacgggtgttgggtcgtttgttcataaacgcggggttcgggatctcgaggctagtctcgtgatcgat

SEQ ID NO: 227 - DNA, 223 bp, Simian virus 40
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 228 - DNA, 785 bp, Artificial sequence
  Synthetic sequence
gagcatcttaccgccatttattcccatatttgttctgtttttcttgatttgggtatacatttgaatgtcaataaaacaaaatggtggggcaatcatctacatttcatgggatatgtgattactagttcaggtgtattgccacaagacaaacatgttaagaaaatttcccgttatttgcactctgttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgt

SEQ ID NO: 229 - DNA, 1034 bp, Hepatitis B virus
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggagaccaccgtgaacgcccaccggaacctgcccaaggtcttgcataagaggactcttggactttcagcaatgtcaacgaccgaccttgaggcatacttcaaagactgtgtgtttaatgagtgggaggagctgggggaggagattaggttaaaggtctttgtactcggaggctgtaggcataaattggtctgttca

SEQ ID NO: 230 - DNA, 779 bp, Spermophilus parryii
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtcgttctgctacgtcccttcggcagcgaatccggcggacctgccgtctcgaggccttctgccggctctgcatcccgtgccgactctccgcttccgtccgcagctgagtcgcatctccctttgggccgcctccccgcctgt

SEQ ID NO: 231 - DNA, 785 bp, Otospermophilus beecheyi
gagcatcttaccgccgtttattcccatatttgctctgtttttcttgatttgggcatacatctaaatgtggaaaaaactaaatggtggggtcacactttacacttcatgggctataccattaatggtgcaggagtgttacctcaagataaacatgtacataaagtaacaacatacttaaaatctattcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtccttctgttacgtcccctccgcggacaacccagcggaccttccgtctcggggacttctgccggctctccgtcctctgccgcttctgcgttttcgtccggtcaccaagcggatatccctgtgggccgcctccccgcctgt

SEQ ID NO: 232 - DNA, 589 bp, Woodchuck Hepatitis B virus
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgc

SEQ ID NO: 233 - DNA, 589 bp, Woodchuck Hepatitis B virus
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgc

SEQ ID NO: 234 - DNA, 578 bp, Spermophilus parryii
aacctttagattataaaatctgtgaaaggttaacaggcattctgaattatgttggtccttttactaaatgtggttatgctgctctccttcctttgtatcaagctacttcgcgtacggcatttgtgttttcttctctctaccacagctggttgctgtccctttatgctgagttgtggcctgttgccaggcaacgaggcgtggtgtgctctgtgtctgacgcaaccccctctggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctatccatggctgctcgcctctgttgccaactggattcttcgcgggacgtcgttctgctacgtgccttcggcagcgaatccggcggaccttccttctcgaggccttctgccggctctgcatcccgtgccgactctccgcttccgtccgcagctgagtcgcatctccctttggcccgcctccccg

SEQ ID NO: 235 - DNA, 657 bp, Spermophilus parryii
gctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcggggccaggcaacgaggcgtggtgtgctctgtgtctgacgcaacccccactggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctatccatggctgctcgcctctgttgccaactggattcttcgcgggacgtcgttctgctacgtccgttcggcagcgaatccggcggacccgccttctcgaggccttctgccggctctgcatcccgtgccgactctccgcttccgtccgcagctgagtcgcatctcccttcgggccgcctccccg

SEQ ID NO: 236 - DNA, 747 bp, Woodchuck Hepatitis B virus
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggac

SEQ ID NO: 237 - DNA, 726 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatc

SEQ ID NO: 238 - DNA, 578 bp, Artificial sequence
  Synthetic sequence
aacctttagattataaaatctgtgaaaggttaacaggcattctgaattatgttggtccttttactaaatgtggttatgctgctctccttcctttgtatcaagctacttcgcgtacggcatttgtgttttcttctctctaccacatctggttgctgtccctttatgctgagttgtggcctgttgccaggcaacgaggcgtggtgtgctctgtgtctgacgcaaccccctctggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctttccttggctgctcgcctctgttgccaactggattcttcgcgggacgtcgttctgctacgtgccttcggcagcgaatccggcggaccttccttctcgaggccttctgccggctctgcatcccgtgccgactctccgcttccgtccgcagctgagtcgcatctccctttggcccgcctccccg

SEQ ID NO: 239 - DNA, 1536 bp, Artificial sequence
  Synthetic sequence
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatc

SEQ ID NO: 240 - DNA, 726 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatc

SEQ ID NO: 241 - DNA, 726 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatc

SEQ ID NO: 242 - DNA, 785 bp, Artificial sequence
  Synthetic sequence
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 243 - DNA, 601 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 244 - DNA, 601 bp, Artificial sequence
  Synthetic sequence
ttcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgt

SEQ ID NO: 245 - DNA, 779 bp, Artificial sequence
  Synthetic sequence
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgt

SEQ ID NO: 246 - DNA, 785 bp, Artificial sequence
  Synthetic sequence
gagcatcttaccgccgtttattcccatatttgctctgtttttcttgatttgggcatacatctaaatgtggaaaaaactaaatggtggggtcacactttacacttcatgggctataccattaatggtgcaggagtgttacctcaagataaacatgtacataaagtaacaacatacttaaaatctattcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgt

SEQ ID NO: 247 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 248 - DNA, 785 bp, Artificial sequence
  Synthetic sequence
gagcatcttaccgccatttattcccatatttgttctgtttttcttgatttgggtatacatttgaatgtcaataaaacaaaatggtggggcaatcatctacatttcatgggatatgtgattactagttcaggtgtattgccacaagacaaacatgttaagaaaatttcccgttatttgcactctgttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgt

SEQ ID NO: 249 - DNA, 601 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgt

SEQ ID NO: 250 - DNA, 785 bp, Artificial sequence
  Synthetic sequence
gagcatcttaccgccatttattcccatatttgttctgtttttcttgatttgggtatacatttgaatgtcaataaaacaaaatggtggggcaatcatctacatttcatgggatatgtgattactagttcaggtgtattgccacaagacaaacatgttaagaaaatttcccgttatttgcactctgttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 251 - DNA, 785 bp, Artificial sequence
  Synthetic sequence
gagcatcttaccgccgtttattcccatatttgctctgtttttcttgatttgggcatacatctaaatgtggaaaaaactaaatggtggggtcacactttacacttcatgggctataccattaatggtgcaggagtgttacctcaagataaacatgtacataaagtaacaacatacttaaaatctattcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 252 - DNA, 785 bp, Artificial sequence
  Synthetic sequence
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 253 - DNA, 779 bp, Artificial sequence
  Synthetic sequence
gagcatcttaccgccatttattcccatatttgttctgtttttcttgatttgggtatacatttgaatgtcaataaaacaaaatggtggggcaatcatctacatttcatgggatatgtgattactagttcaggtgtattgccacaagacaaacatgttaagaaaatttcccgttatttgcactctgttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 254 - DNA, 785 bp, Artificial sequence
  Synthetic sequence
gagcatcttaccgccgtttattcccatatttgctctgtttttcttgatttgggcatacatctaaatgtggaaaaaactaaatggtggggtcacactttacacttcatgggctataccattaatggtgcaggagtgttacctcaagataaacatgtacataaagtaacaacatacttaaaatctattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgt

SEQ ID NO: 255 - DNA, 601 bp, Artificial sequence
  Synthetic sequence
ttcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 256 - DNA, 785 bp, Artificial sequence
  Synthetic sequence
gagcatcttaccgccgtttattcccatatttgctctgtttttcttgatttgggcatacatctaaatgtggaaaaaactaaatggtggggtcacactttacacttcatgggctataccattaatggtgcaggagtgttacctcaagataaacatgtacataaagtaacaacatacttaaaatctattcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 257 - DNA, 785 bp, Artificial sequence
  Synthetic sequence
gagcatcttaccgccatttattcccatatttgttctgtttttcttgatttgggtatacatttgaatgtcaataaaacaaaatggtggggcaatcatctacatttcatgggatatgtgattactagttcaggtgtattgccacaagacaaacatgttaagaaaatttcccgttatttgcactctgttcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgt

SEQ ID NO: 258 - DNA, 785 bp, Artificial sequence
  Synthetic sequence
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgt

SEQ ID NO: 259 - DNA, 779 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgt

SEQ ID NO: 260 - DNA, 779 bp, Artificial sequence
  Synthetic sequence
gagcatcttaccgccgtttattcccatatttgctctgtttttcttgatttgggcatacatctaaatgtggaaaaaactaaatggtggggtcacactttacacttcatgggctataccattaatggtgcaggagtgttacctcaagataaacatgtacataaagtaacaacatacttaaaatctattccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 261 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgt

SEQ ID NO: 262 - DNA, 779 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 263 - DNA, 595 bp, Artificial sequence
  Synthetic sequence
ttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 264 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 265 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgt

SEQ ID NO: 266 - DNA, 755 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 267 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 268 - DNA, 842 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtttcgcctcgccgtccggtccgtgttgcctgggcttcacctgtgcagaattcggagcc

SEQ ID NO: 269 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctttccgcggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 270 - DNA, 601 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 271 - DNA, 724 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcgcggaggccaccgtgaacgcccaccggaacctgcccaaggtcttgcataagaggactcttggactttcagca

SEQ ID NO: 272 - DNA, 944 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggaccagaa

SEQ ID NO: 273 - DNA, 944 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggaccagaa

SEQ ID NO: 274 - DNA, 658 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtttcgcctcgccgtccggtccgtgttgcctgggcttcacctgtgcagaattcggagcc

SEQ ID NO: 275 - DNA, 760 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggaccagaa

SEQ ID NO: 276 - DNA, 939 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 277 - DNA, 760 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggaccagaa

SEQ ID NO: 278 - DNA, 908 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctttccgcggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcgcggaggccaccgtgaacgcccaccggaacctgcccaaggtcttgcataagaggactcttggactttcagca

SEQ ID NO: 279 - DNA, 601 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 280 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 281 - DNA, 908 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcgcggaggccaccgtgaacgcccaccggaacctgcccaaggtcttgcataagaggactcttggactttcagca

SEQ ID NO: 282 - DNA, 939 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 283 - DNA, 785 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 284 - DNA, 601 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 285 - DNA, 601 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctttccgcggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgt

SEQ ID NO: 286 - DNA, 658 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtttcgcctcgccgtccggtccgtgttgcctgggcttcacctgtgcagaattcggagcc

SEQ ID NO: 287 - DNA, 724 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcgcggaggccaccgtgaacgcccaccggaacctgcccaaggtcttgcataagaggactcttggactttcagca

SEQ ID NO: 288 - DNA, 755 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 289 - DNA, 842 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtttcgcctcgccgtccggtccgtgttgcctgggcttcacctgtgcagaattcggagcc

SEQ ID NO: 290 - DNA, 755 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 291 - DNA, 755 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 292 - DNA, 755 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 293 - DNA, 184 bp, Artificial sequence
  Synthetic sequence
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatcca

SEQ ID NO: 294 - DNA, 184 bp, Artificial sequence
  Synthetic sequence
gagcatcttaccgccgtttattcccatatttgctctgtttttcttgatttgggcatacatctaaatgtggaaaaaactaaatggtggggtcacactttacacttcatgggctataccattaatggtgcaggagtgttacctcaagataaacatgtacataaagtaacaacatacttaaaatcta

SEQ ID NO: 295 - DNA, 184 bp, Artificial sequence
  Synthetic sequence
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaac

SEQ ID NO: 296 - DNA, 184 bp, Artificial sequence
  Synthetic sequence
gagcatcttaccgccatttattcccatatttgttctgtttttcttgatttgggtatacatttgaatgtcaataaaacaaaatggtggggcaatcatctacatttcatgggatatgtgattactagttcaggtgtattgccacaagacaaacatgttaagaaaatttcccgttatttgcactctg

SEQ ID NO: 297 - DNA, 225 bp, Artificial sequence
  Synthetic sequence
ttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgt

SEQ ID NO: 298 - DNA, 231 bp, Artificial sequence
  Synthetic sequence
ttcctattaatcaacccttagattataaaatatgtgaaaggttgacgggcattcttaattatgttgctccttttaccaaatgtggttatgctgctttactgcctttatatcaagctattgcttctcatactgcttttgttttctcctccttatataaaaactggttactgtcactttatggtgagttgtggcccgttgccagacaacgtggtgtggtgtgctctgtgtttg

SEQ ID NO: 299 - DNA, 231 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttg

SEQ ID NO: 300 - DNA, 231 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttg

SEQ ID NO: 301 - DNA, 193 bp, Artificial sequence
  Synthetic sequence
ctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggct

SEQ ID NO: 302 - DNA, 193 bp, Artificial sequence
  Synthetic sequence
ctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggct

SEQ ID NO: 303 - DNA, 193 bp, Artificial sequence
  Synthetic sequence
ctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggct

SEQ ID NO: 304 - DNA, 193 bp, Artificial sequence
  Synthetic sequence
ctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggct

SEQ ID NO: 305 - DNA, 193 bp, Artificial sequence
  Synthetic sequence
ctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggct

SEQ ID NO: 306 - DNA, 193 bp, Artificial sequence
  Synthetic sequence
ctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctttccgcggct

SEQ ID NO: 307 - DNA, 193 bp, Artificial sequence
  Synthetic sequence
ctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggct

SEQ ID NO: 308 - DNA, 177 bp, Artificial sequence
  Synthetic sequence
gctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgt

SEQ ID NO: 309 - DNA, 177 bp, Artificial sequence
  Synthetic sequence
gctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgt

SEQ ID NO: 310 - DNA, 303 bp, Artificial sequence
  Synthetic sequence
gctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatg

SEQ ID NO: 311 - DNA, 177 bp, Artificial sequence
  Synthetic sequence
gctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgt

SEQ ID NO: 312 - DNA, 336 bp, Artificial sequence
  Synthetic sequence
gctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggaccagaa

SEQ ID NO: 313 - DNA, 331 bp, Artificial sequence
  Synthetic sequence
gctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 314 - DNA, 234 bp, Artificial sequence
  Synthetic sequence
gctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtttcgcctcgccgtccggtccgtgttgcctgggcttcacctgtgcagaattcggagcc

SEQ ID NO: 315 - DNA, 300 bp, Artificial sequence
  Synthetic sequence
gctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcgcggaggccaccgtgaacgcccaccggaacctgcccaaggtcttgcataagaggactcttggactttcagca

SEQ ID NO: 316 - DNA, 157 bp, Artificial sequence
  Synthetic sequence
catgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggac

SEQ ID NO: 317 - DNA, 4122 bp, Artificial sequence
  Synthetic sequence
attaactgtctaactggatccaagcttggcgcgcctgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaggtaccgaattcgaggatcttcagcgtacgccggagtacacgcgcgcttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagagaccgagtttattcttgacacagatatttatgatataataactgagtaagcttaacataaggaggaaaaacatatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgaaatcctccgcgctgtagaagtcaccattgttgtgcacgacgacatcattccgtggcgttatccagctaagcgcgaactgcaatttggagaatggcagcgcaatgacattcttgcaggaatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggtagaagagcggtctctaaaagagtcgaataagggcgacacattctgaaatgagctgttgacaattaatcatccggctcgtatataggaggtaaaaaaatgtcccacttggcggaattggtagcgagcgcgaaagcagcaattagccaggcaagcgacgtggcagcgctggataatgtccgtgtggagtatctgggtaaaaagggccacctgaccctgcaaatgacgaccttgcgtgagttgccgccagaagaacgtccggcagccggtgcggtgattaatgaagcgaaagagcaagtgcaacaggcgctgaatgcccgtaaggctgagctggagagcgctgcgctgaacgcgcgtttggccgcagaaacgatcgacgtgagcctgccgggtcgtcgtatcgagaacggtggcctgcatccggttacgcgtaccatcgaccgcattgagagcttcttcggcgaactgggttttaccgtggcgacgggtccggagatcgaggatgactaccacaacttcgacgctctgaacatcccgggtcaccacccagcacgtgccgaccatgacaccttttggttcgatacgacccgtctgctgcgtacccaaacttccggtgttcagatccgtaccatgaaagcccagcagccgccgattcgtattatcgcgcctggtcgcgtgtatcgcaacgattacgaccagacccacaccccgatgttccatcaaatggaaggcctgattgttgatacgaacatctcttttaccaatctgaaaggcaccctgcatgatttcctgcgtaactttttcgaagaggatctgcagattcgcttccgtccgagctactttccgtttacggagccgtcggcggaagttgatgtcatgggtaagaatggtaagtggctggaagttctgggttgcggcatggttcacccgaatgtcctgcgcaatgtcggcattgaccctgaggtctacagcggctttggttttggtatgggtatggagcgcctgactatgctgcgctatggcgttaccgatttgcgcagctttttcgaaaacgatctgcgcttcctgaaacaattcaagtagggtctcttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctaattaaggcctta

SEQ ID NO: 318 - DNA, 4122 bp, Artificial sequence
  Synthetic sequence
attaactgtctaactggatccaagcttggcgcgcctgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaggtaccgaattcgaggatcttcagcgtacgccggagtacacgcgcgcttaattaaggccttaattaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactgaagagaccctacttgaattgtttcaggaagcgcagatcgttttcgaaaaagctgcgcaaatcggtaacgccatagcgcagcatagtcaggcgctccatacccataccaaaaccaaagccgctgtagacctcagggtcaatgccgacattgcgcaggacattcgggtgaaccatgccgcaacccagaacttccagccacttaccattcttacccatgacatcaacttccgccgacggctccgtaaacggaaagtagctcggacggaagcgaatctgcagatcctcttcgaaaaagttacgcaggaaatcatgcagggtgcctttcagattggtaaaagagatgttcgtatcaacaatcaggccttccatttgatggaacatcggggtgtgggtctggtcgtaatcgttgcgatacacgcgaccaggcgcgataatacgaatcggcggctgctgggctttcatggtacggatctgaacaccggaagtttgggtacgcagcagacgggtcgtatcgaaccaaaaggtgtcatggtcggcacgtgctgggtggtgacccgggatgttcagagcgtcgaagttgtggtagtcatcctcgatctccggacccgtcgccacggtaaaacccagttcgccgaagaagctctcaatgcggtcgatggtacgcgtaaccggatgcaggccaccgttctcgatacgacgacccggcaggctcacgtcgatcgtttctgcggccaaacgcgcgttcagcgcagcgctctccagctcagccttacgggcattcagcgcctgttgcacttgctctttcgcttcattaatcaccgcaccggctgccggacgttcttctggcggcaactcacgcaaggtcgtcatttgcagggtcaggtggccctttttacccagatactccacacggacattatccagcgctgccacgtcgcttgcctggctaattgctgctttcgcgctcgctaccaattccgccaagtgggacatttttttacctcctatatacgagccggatgattaattgtcaacagctcatttcagaatgtgtcgcccttattcgactcttttagagaccgctcttctaccttatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagattcctgcaagaatgtcattgcgctgccattctccaaattgcagttcgcgcttagctggataacgccacggaatgatgtcgtcgtgcacaacaatggtgacttctacagcgcggaggatttcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatatgtttttcctccttatgttaagcttactcagttattatatcataaatatctgtgtcaagaataaactcggtctctagagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctta

SEQ ID NO: 319 - DNA, 4149 bp, Artificial sequence
  Synthetic sequence
attaactgtctaactggtccgatccggcgcgcctgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaggtaccggatccgaattcgccgaggatcttcagcgtacgccggagtacacgcgcaaaggccggacatcgcggccgcttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagagaccgagtttattcttgacacagatatttatgatataataactgagtaagcttaacataaggaggaaaaacatatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgaaatcctccgcgctgtagaagtcaccattgttgtgcacgacgacatcattccgtggcgttatccagctaagcgcgaactgcaatttggagaatggcagcgcaatgacattcttgcaggaatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggtagaagagcggtctctaaaagagtcgaataagggcgacacattctgaaatgagctgttgacaattaatcatccggctcgtatataggaggtaaaaaaatgtcccacttggcggaattggtagcgagcgcgaaagcagcaattagccaggcaagcgacgtggcagcgctggataatgtccgtgtggagtatctgggtaaaaagggccacctgaccctgcaaatgacgaccttgcgtgagttgccgccagaagaacgtccggcagccggtgcggtgattaatgaagcgaaagagcaagtgcaacaggcgctgaatgcccgtaaggctgagctggagagcgctgcgctgaacgcgcgtttggccgcagaaacgatcgacgtgagcctgccgggtcgtcgtatcgagaacggtggcctgcatccggttacgcgtaccatcgaccgcattgagagcttcttcggcgaactgggttttaccgtggcgacgggtccggagatcgaggatgactaccacaacttcgacgctctgaacatcccgggtcaccacccagcacgtgccgaccatgacaccttttggttcgatacgacccgtctgctgcgtacccaaacttccggtgttcagatccgtaccatgaaagcccagcagccgccgattcgtattatcgcgcctggtcgcgtgtatcgcaacgattacgaccagacccacaccccgatgttccatcaaatggaaggcctgattgttgatacgaacatctcttttaccaatctgaaaggcaccctgcatgatttcctgcgtaactttttcgaagaggatctgcagattcgcttccgtccgagctactttccgtttacggagccgtcggcggaagttgatgtcatgggtaagaatggtaagtggctggaagttctgggttgcggcatggttcacccgaatgtcctgcgcaatgtcggcattgaccctgaggtctacagcggctttggttttggtatgggtatggagcgcctgactatgctgcgctatggcgttaccgatttgcgcagctttttcgaaaacgatctgcgcttcctgaaacaattcaagtagggtctcttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctaattaaggcctta

SEQ ID NO: 320 - DNA, 4149 bp, Artificial sequence
  Synthetic sequence
attaactgtctaactggtccgatccggcgcgcctgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaggtaccggatccgaattcgccgaggatcttcagcgtacgccggagtacacgcgcaaaggccggacatcgcggccgcttaattaaggccttaattaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactgaagagaccctacttgaattgtttcaggaagcgcagatcgttttcgaaaaagctgcgcaaatcggtaacgccatagcgcagcatagtcaggcgctccatacccataccaaaaccaaagccgctgtagacctcagggtcaatgccgacattgcgcaggacattcgggtgaaccatgccgcaacccagaacttccagccacttaccattcttacccatgacatcaacttccgccgacggctccgtaaacggaaagtagctcggacggaagcgaatctgcagatcctcttcgaaaaagttacgcaggaaatcatgcagggtgcctttcagattggtaaaagagatgttcgtatcaacaatcaggccttccatttgatggaacatcggggtgtgggtctggtcgtaatcgttgcgatacacgcgaccaggcgcgataatacgaatcggcggctgctgggctttcatggtacggatctgaacaccggaagtttgggtacgcagcagacgggtcgtatcgaaccaaaaggtgtcatggtcggcacgtgctgggtggtgacccgggatgttcagagcgtcgaagttgtggtagtcatcctcgatctccggacccgtcgccacggtaaaacccagttcgccgaagaagctctcaatgcggtcgatggtacgcgtaaccggatgcaggccaccgttctcgatacgacgacccggcaggctcacgtcgatcgtttctgcggccaaacgcgcgttcagcgcagcgctctccagctcagccttacgggcattcagcgcctgttgcacttgctctttcgcttcattaatcaccgcaccggctgccggacgttcttctggcggcaactcacgcaaggtcgtcatttgcagggtcaggtggccctttttacccagatactccacacggacattatccagcgctgccacgtcgcttgcctggctaattgctgctttcgcgctcgctaccaattccgccaagtgggacatttttttacctcctatatacgagccggatgattaattgtcaacagctcatttcagaatgtgtcgcccttattcgactcttttagagaccgctcttctaccttatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagattcctgcaagaatgtcattgcgctgccattctccaaattgcagttcgcgcttagctggataacgccacggaatgatgtcgtcgtgcacaacaatggtgacttctacagcgcggaggatttcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatatgtttttcctccttatgttaagcttactcagttattatatcataaatatctgtgtcaagaataaactcggtctctagagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctta

SEQ ID NO: 321 - DNA, 2156 bp, Artificial sequence
  Synthetic sequence
tacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctaattaaggccttaattaactgtctaactggatccaagcttggcgcgcctgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaggtaccgaattcgaggatcttcagcgtacgccggagtacacgcgcgcttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgta

SEQ ID NO: 322 - DNA, 2183 bp, Artificial sequence
  Synthetic sequence
tacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctaattaaggccttaattaactgtctaactggtccgatccggcgcgcctgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaggtaccggatccgaattcgccgaggatcttcagcgtacgccggagtacacgcgcaaaggccggacatcgcggccgcttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgta

SEQ ID NO: 323 - DNA, 904 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 324 - DNA, 1544 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 325 - DNA, 1568 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 326 - DNA, 1190 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 327 - DNA, 922 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 328 - DNA, 1610 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgacctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 329 - DNA, 1208 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 330 - DNA, 1488 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 331 - DNA, 1513 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 332 - DNA, 1049 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 333 - DNA, 1036 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 334 - DNA, 1786 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 335 - DNA, 810 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 336 - DNA, 1450 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 337 - DNA, 1474 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 338 - DNA, 1096 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 339 - DNA, 828 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 340 - DNA, 1540 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 341 - DNA, 1114 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 342 - DNA, 669 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 343 - DNA, 1394 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 344 - DNA, 1419 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 345 - DNA, 955 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 346 - DNA, 1667 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 347 - DNA, 1692 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 348 - DNA, 1228 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 349 - DNA, 597 bp, Artificial sequence
  Synthetic sequence
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 350 - DNA, 1237 bp, Artificial sequence
  Synthetic sequence
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 351 - DNA, 1261 bp, Artificial sequence
  Synthetic sequence
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 352 - DNA, 883 bp, Artificial sequence
  Synthetic sequence
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 353 - DNA, 1303 bp, Artificial sequence
  Synthetic sequence
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgacctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 354 - DNA, 1327 bp, Artificial sequence
  Synthetic sequence
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 355 - DNA, 901 bp, Artificial sequence
  Synthetic sequence
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 356 - DNA, 456 bp, Artificial sequence
  Synthetic sequence
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 357 - DNA, 1206 bp, Artificial sequence
  Synthetic sequence
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 358 - DNA, 729 bp, Artificial sequence
  Synthetic sequence
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 359 - DNA, 1454 bp, Artificial sequence
  Synthetic sequence
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 360 - DNA, 1015 bp, Artificial sequence
  Synthetic sequence
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 361 - DNA, 1181 bp, Artificial sequence
  Synthetic sequence
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 362 - DNA, 669 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacc

SEQ ID NO: 363 - DNA, 575 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacc

SEQ ID NO: 364 - DNA, 671 bp, Artificial sequence
  Synthetic sequence
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacc

SEQ ID NO: 365 - DNA, 577 bp, Artificial sequence
  Synthetic sequence
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacc

SEQ ID NO: 366 - DNA, 1366 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacccacc

SEQ ID NO: 367 - DNA, 1720 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacccacc

SEQ ID NO: 368 - DNA, 1626 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacccacc

SEQ ID NO: 369 - DNA, 737 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagagcttccttcttctttttcctagaagctcagaataaacgctcaactttggccgccacc

SEQ ID NO: 370 - DNA, 847 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacccacc

SEQ ID NO: 371 - DNA, 1652 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 372 - DNA, 1384 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacccacc

SEQ ID NO: 373 - DNA, 751 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacccacc

SEQ ID NO: 374 - DNA, 1290 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacccacc

SEQ ID NO: 375 - DNA, 1225 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacccacc

SEQ ID NO: 376 - DNA, 1272 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacccacc

SEQ ID NO: 377 - DNA, 1357 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacccacc

SEQ ID NO: 378 - DNA, 753 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacccacc

SEQ ID NO: 379 - DNA, 643 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagagcttccttcttctttttcctagaagctcagaataaacgctcaactttggccgccacc

SEQ ID NO: 380 - DNA, 1570 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacccacc

SEQ ID NO: 381 - DNA, 1664 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacccacc

SEQ ID NO: 382 - DNA, 1131 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacccacc

SEQ ID NO: 383 - DNA, 1664 bp, Artificial sequence; identical to SEQ ID NO: 381
  Synthetic sequence

SEQ ID NO: 384 - DNA, 845 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacccacc

SEQ ID NO: 385 - DNA, 1786 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgacctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacccacc

SEQ ID NO: 386 - DNA, 1914 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctggagacgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctcaggggagcttccttcttctttttcctagaagctcagaataaacgctcaactttggccgccacc

SEQ ID NO: 387 - DNA, 1076 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 388 - DNA, 1716 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 389 - DNA, 1740 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 390 - DNA, 1362 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 391 - DNA, 1094 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 392 - DNA, 1782 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgacctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 393 - DNA, 1380 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 394 - DNA, 1660 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 395 - DNA, 1685 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 396 - DNA, 1221 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 397 - DNA, 1208 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 398 - DNA, 1958 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 399 - DNA, 982 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 400 - DNA, 1622 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 401 - DNA, 1646 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 402 - DNA, 1268 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 403 - DNA, 1000 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 404 - DNA, 1712 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 405 - DNA, 1286 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 406 - DNA, 841 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 407 - DNA, 1566 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 408 - DNA, 1591 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 409 - DNA, 1127 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 410 - DNA, 1839 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 411 - DNA, 1864 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 412 - DNA, 1400 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 413 - DNA, 769 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactcttggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 414 - DNA, 1409 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactcttggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 415 - DNA, 1433 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactcttggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 416 - DNA, 1055 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactcttggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 417 - DNA, 1475 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgacctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 418 - DNA, 1499 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 419 - DNA, 1073 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 420 - DNA, 628 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 421 - DNA, 1378 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 422 - DNA, 901 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 423 - DNA, 1626 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 424 - DNA, 1187 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 425 - DNA, 1353 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 426 - DNA, 841 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacc

SEQ ID NO: 427 - DNA, 747 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacc

SEQ ID NO: 428 - DNA, 843 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacc

SEQ ID NO: 429 - DNA, 749 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctgccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacc

SEQ ID NO: 430 - DNA, 1708 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctggagacgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccagcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccgcggcggcgccctataaaacccagcggcgcgacgcgccaccaccgccgagtccgcgtccgcccgcgagcacagagcctcgcctttgccgatccgccgcccgtccacacccgccgccaggtaagcccggccagccgaccggggcatgcggccgcggcccttcgcccgtgcagagccgccgtctgggccgcagcggggggcgcatggggcggaaccggaccgccgtggggggcgcgggagaagcccctgggcctccggagatgggggacaccccacgccagttcgcaggcgcgaggccgcgctcgggcgggcgcgctccgggggtgccgctctcggggcgggggcaaccggcggggtctttgtctgagccgggctcttgccaatggggatcgcacggtgggcgcggcgtagcccccgtcaggcccggtgggggctggggcgccatgcgcgtgcgcgctggtcctttgggcgctaactgcgtgcgcgctgggaattggcgctaattgcgcgtgcgcgctgggactcaatggcgctaatcgcgcgtgcgttctggggcccgggcgcttgcgccacttcctgcccgagccgctggcgcccgagggtgtggccgctgcgtgcgcgcgcgcgacccggtcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcggcagcggctgctcttggcggccccgaggtgactatagccttcttttgtgtcttgatagttcgccagcctctgctaaccatgttcatgccttcttctttttcctacagctcctgggcaacgtgctggttattgtgctgtctcatcattttggcaaagaattcggcttgatcgaagccgtctca

SEQ ID NO: 431 - DNA, 1852 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctggagacgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctca

SEQ ID NO: 432 - DNA, 1754 bp, Artificial sequence
  Synthetic sequence
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtactctccaacattaccgccatgttgacttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacagctcctgggcaacgtgctggttattgtgctgtctcatcattttggcaaagaattgccacc

SEQ ID NO: 433 - DNA, 942 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggg

SEQ ID NO: 434 - DNA, 869 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 435 - DNA, 840 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggg

SEQ ID NO: 436 - DNA, 976 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 437 - DNA, 1078 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 438 - DNA, 812 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 439 - DNA, 914 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 440 - DNA, 971 bp, Artificial sequence
  Synthetic sequence
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 441 - DNA, 1006 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 442 - DNA, 977 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggg

SEQ ID NO: 443 - DNA, 1113 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 444 - DNA, 1079 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggg

SEQ ID NO: 445 - DNA, 1051 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 446 - DNA, 1215 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 447 - DNA, 949 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 448 - DNA, 1108 bp, Artificial sequence
  Synthetic sequence
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgctggagcctcggtagccgttcctcctgcccgctgggcctcccaacgggccctcctcccctccttgcaccggcccttcctggtctttgaataaattcattgctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 449 - DNA, 325 bp, Artificial sequence
  Synthetic sequence
gctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 450 - DNA, 489 bp, Artificial sequence
  Synthetic sequence
gctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 451 - DNA, 382 bp, Artificial sequence
  Synthetic sequence
gctggagcctcggtagccgttcctcctgcccgctgggcctcccaacgggccctcctcccctccttgcaccggcccttcctggtctttgaataaattcattgctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 452 - DNA, 353 bp, Artificial sequence
  Synthetic sequence
gctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggg

SEQ ID NO: 453 - DNA, 223 bp, Artificial sequence; identical to SEQ ID NO: 227
  Synthetic sequence

SEQ ID NO: 454 - DNA, 387 bp, Artificial sequence; identical to SEQ ID NO: 214
  Synthetic sequence

SEQ ID NO: 455 - DNA, 280 bp, Artificial sequence; identical to SEQ ID NO: 192
  Synthetic sequence

SEQ ID NO: 456 - DNA, 251 bp, Artificial sequence; identical to SEQ ID NO: 206
  Synthetic sequence

SEQ ID NO: 457 - DNA, 2710 bp, Artificial sequence
  Synthetic sequence
taatggataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaagaggtgaggcacaggtcccaggtcaggctggccagagctctgtttattacgtctcacagctttgagtcctgctctcaaccagagaggccctttaccaagaagtcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 458 - DNA, 2338 bp, Artificial sequence
  Synthetic sequence
taatggattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 459 - DNA, 2419 bp, Artificial sequence
  Synthetic sequence
taatggaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 460 - DNA, 3339 bp, Artificial sequence
  Synthetic sequence
taatggattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggactaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtactcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 461 - DNA, 3229 bp, Artificial sequence
  Synthetic sequence
taatggattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggactggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 462 - DNA, 2449 bp, Artificial sequence
  Synthetic sequence
taatggattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 463 - DNA, 2686 bp, Artificial sequence
  Synthetic sequence
taatggaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 464 - DNA, 3325 bp, Artificial sequence
  Synthetic sequence
taatggattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 465 - DNA, 2777 bp, Artificial sequence
  Synthetic sequence
taatggattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 466 - DNA, 2851 bp, Artificial sequence
  Synthetic sequence
taatggattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 467 - DNA, 2760 bp, Artificial sequence
  Synthetic sequence
taatggaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 468 - DNA, 2714 bp, Artificial sequence
  Synthetic sequence
taatggagctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtactcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 469 - DNA, 3323 bp, Artificial sequence
  Synthetic sequence
taatggagctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaagaggtgaggcacaggtcccaggtcaggctggccagagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctgtaaggctaccccaaggaggagaaggtgagggtggatcagctggagactggaaacatatcacagctgccaggggctgccaggccccagagggcctgagaactgggtttgggctggagaggatgtccattattcaagaaagaggctgttacatgcatgggcttcaggacttgtgtttcaaaatatcccagatgtggatagtgcgaccggaggtcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 470 - DNA, 3433 bp, Artificial sequence
  Synthetic sequence
taatggagctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaagaggtgaggcacaggtcccaggtcaggctggccagagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctgtaaggctaccccaaggaggagaaggtgagggtggatcagctggagactggaaacatatcacagctgccaggggctgccaggccccagagggcctgagaactgggtttgggctggagaggatgtccattattcaagaaagaggctgttacatgcatgggcttcaggacttgtgtttcaaaatatcccagatgtggatagtgcgaccggagggctgtcttactttcccagagactcaggaacccagtgagtaatagatgcatgccaaggagtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 471 - DNA, 2506 bp, Artificial sequence
  Synthetic sequence
taatggaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatattcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 472 - DNA, 2412 bp, Artificial sequence
  Synthetic sequence
taatggatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 473 - DNA, 2938 bp, Artificial sequence
  Synthetic sequence
taatggattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatattcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 474 - DNA, 2412 bp, Artificial sequence
  Synthetic sequence
taatggaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 475 - DNA, 3231 bp, Artificial sequence
  Synthetic sequence
taatggaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcctatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 476 - DNA, 2283 bp, Artificial sequence
  Synthetic sequence
taatggaaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 477 - DNA, 2151 bp, Artificial sequence
  Synthetic sequence
taatggattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggtccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagccttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 478 - DNA, 1500 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggactggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctcttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 479 - DNA, 1500 bp, Artificial sequence
  Synthetic sequence
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 480 - DNA, 1846 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtctttttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 481 - DNA, 1578 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 482 - DNA, 2179 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggactggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 483 - DNA, 2366 bp, Artificial sequence
  Synthetic sequence
gctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggcattgatattctacagctggaagaagaaagataatgatctagtaattagctcattaaaaataaacgttcttctttcctcagaggagcatttcccaaggcctgccttgatagcgatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgtgatcatgtggaaaatctgaaagcattttaggttccttatgtttgcaatcaaataactgtacaccttttaatttaaaaagtaccatgaggcacacacacacactcgcaggaactttttggcgtaacaaaactagaattagatctaaagctaactgtaggactgagtctattctaaactgaaagcctggacatctggagtaccagggggagatgacgtgttacgggcttccataaaagcagctggctttgaatggaaggagccaagaggccagcacaggagctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 484 - DNA, 1356 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggttacccaggctggagtgcagtggcacatttctgctcactgcaacctcctcctccctgggttcaagcaattctcctgcctcagcctcccaagtagctgtgattatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 485 - DNA, 1314 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggactggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 486 - DNA, 2366 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggcattgatattctacagctggaagaagaaagataatgatctagtaattagctcattaaaaataaacgttcttctttcctcagaggtcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 487 - DNA, 1578 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 488 - DNA, 1846 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 489 - DNA, 2179 bp, Artificial sequence
  Synthetic sequence
gctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggcattgatattctacagctggaagaagaaagataatgatctagtaattagctcattaaaaataaacgttcttctttcctcagaggagcatttcccaaggcctgccttgatagcgatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgtgatcatgtggaaaatctgaaagcattttaggttccttatgtttgcaatcaaataactgtacaccttttaatttaaaaagtaccatgaggcacacacacacactcgcaggaactttttggcgtaacaaaactagaattagatctaaagctaactgtaggactgagtctattctaaactgaaagcctggacatctggagtaccagggggagatgacgtgttacgggcttcctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 490 - DNA, 1356 bp, Artificial sequence
  Synthetic sequence
ttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagattcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 491 - DNA, 1578 bp, Artificial sequence
  Synthetic sequence
gctggagcctcggtagccgttcctcctgcccgctgggcctcccaacgggccctcctcccctccttgcaccggcccttcctggtctttgaataaattcattgctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaatcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 492 - DNA, 1486 bp, Artificial sequence
  Synthetic sequence
ttcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgcttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctggggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 493 - DNA, 2185 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgctggagcctcggtagccgttcctcctgcccgctgggcctcccaacgggccctcctcccctccttgcaccggcccttcctggtctttgaataaattcattgctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagattcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 494 - DNA, 2366 bp, Artificial sequence
  Synthetic sequence
ttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggactaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggcattgatattctacagctggaagaagaaagataatgatctagtaattagctcattaaaaataaacgttcttctttcctcagaggagcatttcccaaggcctgccttgatagctcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 495 - DNA, 1846 bp, Artificial sequence
  Synthetic sequence
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggcattgatattctacagctggaagaagaaagataatgatctagtaattagctcattaaaaataaacgttcttctttcctcagaggagcatttcccaaggcctgccttgatagcgatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgtgatcatgtggaaaatctgaaagcatttcagtacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgc

SEQ ID NO: 496 - DNA, 1753 bp, Artificial sequence
  Synthetic sequence
tccttccctgccaacacctggctccatccctgcagttatggggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtccccacacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggggaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgtaatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcct

SEQ ID NO: 497 - DNA, 2926 bp, Artificial sequence
  Synthetic sequence
cataatctttatgaagttgcatgcctttgcagcttctcagagtgtattttcatttctaatgtagcaataaaataatatacttactaaaaaaaatagcaagggaagaaaatcatttccttcataccaagtaagagagcacttatcatggtaggcactggctttgcaattatgagtccagtagtagaaatagctttagtttcctcaattttcctgtagtattcttcagactttctttacactgctaaaatgagagtaacatttcattgtataacctctgtacaatttcttaccatgtacatgtattacctacgtaaaaatgcttacaattacaaagataccaatgagtttattttctctactgactcaagttggtgtcacaggcataccaattaaggacaggcattctccaaaaagcatgtagaaacactgtcttttgtactaataaagagcccccatgtcttttcatgtcattgcatattagaattgtgacataggtgttaagtaggaacaaagaggcaacccatttcacagatgtactcagaactgctgggctgtcataggtctaagcagaagagcgaggactaaatccctaattttctgacaccgatgccactgatattttcattatatcaggctgcctcgacctgctggtaagggttaggactagctctctgacagattaccctggttccaatcctgctctgctgggccctaaggtaccatgaaataagatcaccaagctgtattaggtgaaaaaagcaaggtggcatattgtattataccattttgtgcaaaaaaaggtaaaactttaaaaaagaatatatgtctatatgtgcttattacgcataaactgcctgttgcccattgctgctccatctatacaatgtgggtggtaggattacaataaatattgcaaatattagaacagtgcctgtcacactaaagtgtcattttggattctcagtccaaatagttccttggcttaatcatattctaaaatacccctttggtcttgaactcttacctcaggtgatccgcctgactggcctcccaaagtgctgggattacaggggccatcatcttttcttcagaggtagctacagcagatgaaaagatttaaaaatcattttcacgctttaacatttaaggcagtaaaaagcatactggatctctgtaaagggggaatcctatatagttttttctgagttgcagtctcactttgttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggcattgatattctacagctggaagaagaaagataatgatctagtaattagctcattaaaaataaacgttcttctttcctcagaggagcatttcccaaggcctgccttgatagcgatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgtgatcatgtggaaaatctgaaagcattttaggttccttatgtttgcaatcaaataactgtacaccttttaatttaaaaagtaccatgaggcacacacacacactcgcaggaactttttggcgtaacaaaactagaattagatctaaagctaactgtaggactgagtctattctaaactgaaagcctggacatctggagtaccagggggagatgacgtgttacgggcttccataaaagcagctggctttgaatggaaggagccaagaggccagcacaggagc

SEQ ID NO: 498 - DNA, 1738 bp, Artificial sequence
  Synthetic sequence
tatatagttttttctgagttgcagtctcactttgttacccaggctggagtgcagtggcacatttctgctcactgcaacctcctcctccctgggttcaagcaattctcctgcctcagcctcccaagtagctgtgattataggtgcacaccaccaagcctggctaatttttatatctttagtagagacgggagtctcaccatgttggccaggctagtctctggcaagccatggtaaaatgtaactatttaaggctgctttaaattagactaatagcagagtggtcagactatactgaaagcttggtgaatcacaattaagtacctcaaagaactattcttgtttgccttattcctatgtaaataactgaaatctttgtttttcttcctaaaaggggtcatgttgatttttacttacaatgtattttaagtttgtcactctaaatggttatgagcaagtttaagaaaaatcttcagcaaatactaccttagattatgaccccaaaacacatttacttatgattatgttgaaaacatagggtctggggaaaaagggatttaaaataagaagaaaaagaagacttgggacttaaaaagtcttttagaggccagctcaccaacattcagaacacccagtctgtgttgcacaatatgttacttaggtataaatcaaggattcatgtaattttgtcattccttgcgtgatattttaaaaaacattctgtgtaaggtatttataaagctctcttctaaaaatacaaaaatttgtggggccttgtagtcccagctacttgggaggctgaggcaggaggatttcttgaactgggaggcagagcttgcagtgagcccactgcactccagcctgggcaacagagtagaactcctctcaaaaaaaaaaaaaaaaaagaaagaaagaaaaaaaagtggactgtgaaaactgaaaggactagaaaaactacactacaaagatacagaaaccaagaaagcaccaaaggtttgccttcaactgcttcccaacttgttttcctcttccaatttgattgtggtttcctctccagaaggaactccacagtacttagcgttggtcacatagtaggttctcaaatacttgttaataaataagtttgttcgagaagctgggcattgatattctacagctggaagaagaaagataatgatctagtaattagctcattaaaaataaacgttcttctttcctcagaggagcatttcccaaggcctgccttgatagcgatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgtgatcatgtggaaaatctgaaagcattttaggttccttatgtttgcaatcaaataactgtacaccttttaatttaaaaagtaccatgaggcacacacacacactcgcaggaactttttggcgtaacaaaactagaattagatctaaagctaactgtaggactgagtctattctaaactgaaagcctggacatctggagtaccagggggagatgacgtgttacgggcttccataaaagcagctggctttgaatggaaggagccaagaggccagcacaggagc

SEQ ID NO: 499 - DNA, 1753 bp, Artificial sequence
  Synthetic sequence
tccttccctgccaacacctggctccatccctgcagttattgggttgaaaattcccctttttcccttaagctctccccctggttctttaaattacatgatgttagaatttttcaataagcaacccatgcacttgagaagaaattcaacccctcttttattaagttccgggatacctgtgaacagccccccctcccgaactcagagatcagccagcctctgctgggattaaaggtatgcaccaccaacgccccaggttttgtctcaaacaaacaaaaataacatcaggaggtggtgagagggctcagtggtcacaggcattctctgcaaagcctgactctgagttggatcctttagagctacatggttgagggaagagaactgactcctggaaggtgtcctctggtcccctcacatagctatacacagcatgtgcattcacacacactaaataatgctatttttaaaaaaattaaaaacaacaacagtttgggttgtgaaaactagaactagataataggtaagaatcaagtatcatgtaaatttgctttcaactcatcccaaaatttgttttatatttcagtttttttccttcctagcttgactgtggagtcttgtctgaaggggttaattaattaattaacacgttgtgcatagaaacagatgcaggcaaaacatccacacatataaaacaaaaaattaaaaccaataaaactcctaaacttttggtctttcttgaatcttcaatccctcaggttatgaaataatcatttatgcagtcaaaaatttgccattcttgttgccaggtgtggtgatgattcggtgaagcagaagcaggcagatctctgtgaatgaggccagcctggtctacaaagtgagtcccaggacagtcaggcctgttacacagagaaaccttgaaaaaaaaaagataatatgtactgttgtattaccccaatatataaggctaaaccattagaagcacaacactgttaagtacggaaaataatatctagtgtggtacagttactactactataatacactaatatagctgtgggaaactagttccaaagatgaattactaaccagtgtttccaaggaaataaatgaaagcagagagattagttctattgctagtgtttcattttcgtatatttcttacaatttctcttgttacaaataggcactagggtatcaagataattttaacgactggctgagaaccctagaaaatctctgtgaaaaagggatttgtgaaatgagagagggtaatgtggccattatagaaaaggcttttgtgtgccttgcatgcatagaccctgtgtttgatctcttaacaccctccttgaccagaaaaagcttctgtggatagaaaatgattagttatatatacttttagggaaacgtagttctggattctttggttacaattaacagaattaagtgcaaacaaagccagaaacctcctgataaatgagaaaacctgcttgtagaaggttgtaaggctctgtaatataggaattaggagaaaagaaacctgtgtggtggggcacgtctgttatcccagcattgggaagtagaggtagaagattagaaatcaaaggccagcctcagcaacacagtgagtttgaggccaccctgaactacatcaggttctgtctcctttcttttttttttttttttcttttctttttttggtttctctgtgtagttttggagcctatcctggcactagctctgaagagcaggctggcct

SEQ ID NO: 500 - DNA, 193 bp, Artificial sequence
  Synthetic sequence
ggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 501 - DNA, 318 bp, Artificial sequence
  Synthetic sequence
ctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcga

SEQ ID NO: 502 - protein, 21 aa, Artificial sequence
  Synthetic sequence
WIRSDMIRYIDEFGQTTTRMQ

SEQ ID NO: 503 - protein, 373 aa, Artificial sequence
  Synthetic sequence
MATSASSHLNKNIKQMYLCLPQGEKVQAMYIWVDGTGEGLRCKTRTLDCEPKCVEELPEWNFDGSSTFQSEGSNSDMYLSPVAMFRDPFRRDPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKHIEEAIEKLSKRHRYHIRAYDPKGGLDNARRLTGFHETSNINDFSAGVANRSASIRIPRTVGQEKKGYFEDRRPSANCDPFAVTEAIVRTCLLNETGDEPFQYKN

SEQ ID NO: 504 - protein, 373 aa, Rattus norvegicus
MATSASSHLNKGIKQMYMNLPQGEKIQLMYIWVDGTGEGLRCKTRTLDCDPKCVEELPEWNFDGSSTFQSEGSNSDMYLHPVAMFRDPFRRDPNKLVFCEVFKYNRKPAETNLRHSCKRIMDMVSSQHPWFGMEQEYTLMGTDGHPFGWPSNGFPGPQGPYYCGVGADKAYGRDIVEAHYRACLYAGIKITGTNAEVMPAQWEFQIGPCEGIRMGDHLWVARFILHRVCEDFGVIATFDPKPIPGNWNGAGCHTNFSTKAMREENGLRCIEEAIDKLSKRHQYHIRAYDPKGGLDNARRLTGFHETSNINDFSAGVANRSASIRIPRIVGQEKKGYFEDRRPSANCDPYAVTEAIVRTCLLNETGDEPFQYKN

SEQ ID NO: 505 - protein, 373 aa, Artificial sequence
  Synthetic sequence
MATSASSHLNKGIKQMYMSLPQGEKIQAMYIWVDGTGEGLRCKTRTLDCDPKCVEELPEWNFDGSSTFQSEGSNSDMYLHPVAMFRDPFRKDPNKLVLCEVFKYNRKPAETNLRHICKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWIARFILHRVCEDFGVIATFDPKPIPGNWNGAGCHTNFSTKAMREENGLKCIEEAIDKLSKRHQYHIRAYDPKGGLDNARRLTGFHETSNINDFSAGVANRSASIRIPRTVGQEKKGYFEDRRPSANCDPYAVTEAIVRTCLLNETGDEPFQYKN

SEQ ID NO: 506 - protein, 373 aa, Artificial sequence
  Synthetic sequence
MATSASSHLNKNIKQMYLCLPQGEKVQAMYIWVDGTGEGLRCKTRTLDCEPKCVEELPEWNFDGSSTFQSEGSNSDMYLSPVAMFRDPFRREPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIHMGDHLWVARFILHRVCEDFGVIATFDPKPIPGNWNGAGCHTNFSTKAMREENGLKHIEEAIEKLSKRHQYHIRAYDPKGGLDNARRLTGFHETSNINDFSAGVANRSASIRIPRTVGQEKKGYFEDRRPSANCDPFAVTEAIVRTCLLNETGDEPFQYKN

SEQ ID NO: 507 - protein, 373 aa, Cricetulus griseus; identical to SEQ ID NO: 503

SEQ ID NO: 508 - protein, 373 aa, Mus musculus
MATSASSHLNKGIKQMYMSLPQGEKVQAMYIWVDGTGEGLRCKTRTLDCEPKCVEELPEWNFDGSSTFQSEGSNSDMYLHPVAMFRDPFRKDPNKLVLCEVFKYNRKPAETNLRHICKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWIARFILHRVCEDFGVIATFDPKPIPGNWNGAGCHTNFSTKAMREENGLKCIEEAIDKLSKRHQYHIRAYDPKGGLDNARRLTGFHETSNINDFSAGVANRGASIRIPRTVGQEKKGYFEDRRPSANCDPYAVTEAIVRTCLLNETGDEPFQYKN

SEQ ID NO: 509 - DNA, 1122 bp, Artificial sequence
  Synthetic sequence
atggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaa

SEQ ID NO: 510 - DNA, 1122 bp, Rattus norvegicus
atggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaa

SEQ ID NO: 511 - DNA, 1122 bp, Artificial sequence
  Synthetic sequence
atggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaa

SEQ ID NO: 512 - DNA, 1122 bp, Artificial sequence
  Synthetic sequence
atggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaa

SEQ ID NO: 513 - protein, 394 aa, Cricetulus griseus
MATSASSHLNKNIKQMYLCLPQGEKVQAMYIWVDGTGEGLRCKTRTLDCEPKCVEELPEWNFDGSSTFQSEGSNSDMYLSPVAMFRDPFRRDPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKHIEEAIEKLSKRHRYHIRAYDPKGGLDNARRLTGFHETSNINDFSAGVANRSASIRIPRTVGQEKKGYFEDRRPSANCDPFAVTEAIVRTCLLNETGDEPFQYKNWIRSDMIRYIDEFGQTTTRMQ

SEQ ID NO: 514 - protein, 394 aa, Rattus norvegicus
MATSASSHLNKGIKQMYMNLPQGEKIQLMYIWVDGTGEGLRCKTRTLDCDPKCVEELPEWNFDGSSTFQSEGSNSDMYLHPVAMFRDPFRRDPNKLVFCEVFKYNRKPAETNLRHSCKRIMDMVSSQHPWFGMEQEYTLMGTDGHPFGWPSNGFPGPQGPYYCGVGADKAYGRDIVEAHYRACLYAGIKITGTNAEVMPAQWEFQIGPCEGIRMGDHLWVARFILHRVCEDFGVIATFDPKPIPGNWNGAGCHTNFSTKAMREENGLRCIEEAIDKLSKRHQYHIRAYDPKGGLDNARRLTGFHETSNINDFSAGVANRSASIRIPRIVGQEKKGYFEDRRPSANCDPYAVTEAIVRTCLLNETGDEPFQYKNWIRSDMIRYIDEFGQTTTRMQ

SEQ ID NO: 515 - protein, 394 aa, Artificial sequence
  Synthetic sequence
MATSASSHLNKGIKQMYMSLPQGEKIQAMYIWVDGTGEGLRCKTRTLDCDPKCVEELPEWNFDGSSTFQSEGSNSDMYLHPVAMFRDPFRKDPNKLVLCEVFKYNRKPAETNLRHICKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWIARFILHRVCEDFGVIATFDPKPIPGNWNGAGCHTNFSTKAMREENGLKCIEEAIDKLSKRHQYHIRAYDPKGGLDNARRLTGFHETSNINDFSAGVANRSASIRIPRTVGQEKKGYFEDRRPSANCDPYAVTEAIVRTCLLNETGDEPFQYKNWIRSDMIRYIDEFGQTTTRMQ

SEQ ID NO: 516 - protein, 394 aa, Artificial sequence
  Synthetic sequence
MATSASSHLNKNIKQMYLCLPQGEKVQAMYIWVDGTGEGLRCKTRTLDCEPKCVEELPEWNFDGSSTFQSEGSNSDMYLSPVAMFRDPFRREPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIHMGDHLWVARFILHRVCEDFGVIATFDPKPIPGNWNGAGCHTNFSTKAMREENGLKHIEEAIEKLSKRHQYHIRAYDPKGGLDNARRLTGFHETSNINDFSAGVANRSASIRIPRTVGQEKKGYFEDRRPSANCDPFAVTEAIVRTCLLNETGDEPFQYKNWIRSDMIRYIDEFGQTTTRMQ

SEQ ID NO: 517 - protein, 394 aa, Cricetulus griseus; identical to SEQ ID NO: 513

SEQ ID NO: 518 - protein, 394 aa, Mus musculus
MATSASSHLNKGIKQMYMSLPQGEKVQAMYIWVDGTGEGLRCKTRTLDCEPKCVEELPEWNFDGSSTFQSEGSNSDMYLHPVAMFRDPFRKDPNKLVLCEVFKYNRKPAETNLRHICKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWIARFILHRVCEDFGVIATFDPKPIPGNWNGAGCHTNFSTKAMREENGLKCIEEAIDKLSKRHQYHIRAYDPKGGLDNARRLTGFHETSNINDFSAGVANRGASIRIPRTVGQEKKGYFEDRRPSANCDPYAVTEAIVRTCLLNETGDEPFQYKNWIRSDMIRYIDEFGQTTTRMQ

SEQ ID NO: 519 - DNA, 1926 bp, Artificial sequence
  Synthetic sequence
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcggtcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcttcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 520 - DNA, 1926 bp, Artificial sequence
  Synthetic sequence
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 521 - DNA, 2435 bp, Artificial sequence
  Synthetic sequence
aagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 522 - DNA, 1572 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 523 - DNA, 1868 bp, Artificial sequence
  Synthetic sequence
gtgtcttctttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 524 - DNA, 1591 bp, Artificial sequence
  Synthetic sequence
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 525 - DNA, 1535 bp, Artificial sequence
  Synthetic sequence
aagtcttcttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 526 - DNA, 1859 bp, Artificial sequence
  Synthetic sequence
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtactggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgtggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacaggagtgccttaaatttgtctctgcaggcttccggttgtacttgaaaacttcacagaacaccagcttgttgggctcccggcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaggtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtg

SEQ ID NO: 527 - DNA, 1850 bp, Artificial sequence
  Synthetic sequence
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtccgccaccatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactgatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 528 - DNA, 2350 bp, Artificial sequence
  Synthetic sequence
gttccgcccattctccgccccatggctgactaattttttttatttatgcagaggccgaggccgcctcggcctctgagctattccagaagtagtgaggaggcttttttggaggcctaggcttttgcaaaggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 529 - DNA, 2264 bp, Artificial sequence
  Synthetic sequence
gtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 530 - DNA, 1733 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaagtgacataattggacaaactacctacagagatttaaagctctaaggtaaatataaaatttttaagtgtataatgtgttaaactactgattctaattgtttgtgtattttagattccaacctatggaactgatgaatgggagataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 531 - DNA, 2264 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 532 - DNA, 2264 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 533 - DNA, 2264 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 534 - DNA, 2206 bp, Artificial sequence
  Synthetic sequence
aagtcttcttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggggcgcgccgaagacaa

SEQ ID NO: 535 - DNA, 1910 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 536 - DNA, 2030 bp, Artificial sequence
  Synthetic sequence
aagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacaa

SEQ ID NO: 537 - DNA, 1778 bp, Artificial sequence
  Synthetic sequence
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 538 - DNA, 2785 bp, Artificial sequence
  Synthetic sequence
aagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgaggaagacat

SEQ ID NO: 539 - DNA, 2533 bp, Artificial sequence
  Synthetic sequence
atgtcttcctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 540 - DNA, 1920 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaagtgacataattggacaaactacctacagagatttaaagctctaaggtaaatataaaatttttaagtgtataatgtgttaaactactgattctaattgtttgtgtattttagattccaacctatggaactgatgaatgggagataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 541 - DNA, 2069 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 542 - DNA, 2069 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 543 - DNA, 2596 bp, Artificial sequence
  Synthetic sequence
atgtcttcctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaatcattgcatccgtgtagtggtctgaccgaattcgtcgatatatctgatcatatcgcttctaatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 544 - DNA, 1983 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggattagaagcgatatgatcagatatatcgacgaattcggtcagaccactacacggatgcaatgagtgacataattggacaaactacctacagagatttaaagctctaaggtaaatataaaatttttaagtgtataatgtgttaaactactgattctaattgtttgtgtattttagattccaacctatggaactgatgaatgggagataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 545 - DNA, 2132 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 546 - DNA, 2132 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 547 - DNA, 2132 bp, Artificial sequence; identical to SEQ ID NO: 546
  Synthetic sequence

SEQ ID NO: 548 - DNA, 1783 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgagtgacataattggacaaactacctacagagatttaaagctctaaggtaaatataaaatttttaagtgtataatgtgttaaactactgattctaattgtttgtgtattttagattccaacctatggaactgatgaatgggagataatcagccactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaaagacac

SEQ ID NO: 549 - DNA, 1973 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 550 - DNA, 1945 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 551 - DNA, 1945 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 552 - DNA, 1819 bp, Artificial sequence
  Synthetic sequence
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacactttatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggattagaagcgatatgatcagatatatcgacgaattcggtcagaccactacacggatgcaatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaaagaagacac

SEQ ID NO: 553 - DNA, 1588 bp, Artificial sequence
  Synthetic sequence
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 554 - DNA, 1643 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagccctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 555 - DNA, 1643 bp, Artificial sequence
  Synthetic sequence
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagccctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 556 - DNA, 2413 bp, Artificial sequence
  Synthetic sequence
gttccgcccattctccgccccatggctgactaattttttttatttatgcagaggccgaggccgcctcggcctctgagctattccagaagtagtgaggaggcttttttggaggcctaggcttttgcaaaggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgg

SEQ ID NO: 557 - DNA, 7493 bp, Artificial sequence
  Synthetic sequence
gagaccacacccaagctgtctagagccgccaccatggagttggggctgtgctgggttttccttgttgctattttagaaggtgtccagtgtcaagtacagttgcaagagtcaggtccaggattagtaaaaccatcagagacattgtcattaacatgtaccgtatctggtggatcagtttcatctggtgactactattggacttggattagacaatctccaggaaagggattagaatggattggtcatatatactattctggaaatactaattacaatccttctttgaagtcaagattgacaatctcaattgatacttcaaagactcagttctcattaaagttgtcatcagttacagctgccgatacagcaatttattattgtgttagggatagggtaaccggtgccttcgatatttggggtcaaggaactatggttaccgtatcttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcaaaagagcctctccctgtctccgggtaaataatagggtctctaaaagcggccgctcgaggccggcaaggccggatcccccgacctcgacaagggttcgatccctaccggttagtaatgagtttaaactcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggggtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctgtagacgccatccacgctgttttgacctccatagaagacaccgggaccgatccagcctccgggga

SEQ ID NO: 558 - DNA, 4443 bp, Artificial sequence
  Synthetic sequence
tgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctgtagacgccatccacgctgttttgacctccatagaagacaccgggaccgatccagcctccggggagagaccacacccaagctgtctagagccgccaccatggagttggggctgtgctgggttttccttgttgctattttagaaggtgtccagtgtgatatccaaatgactcaatctccttcttctttgtctgcctcagttggagatagagtaacaataacatgtcaagcctcacaggacatatcaaactatttgaattggtatcaacaaaagcctggtaaagctcctaagttattgatatatgatgcctctaacttagaaactggtgttccatctagattctcaggttctggttctggtacagacttcacattcactatttcatctttgcaaccagaagatatagccacatacttctgccagcacttcgatcatttgcctttagcatttggaggtggtaccaaagtcgaaattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatagggtctctaaaagcggccgctcgaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaa

SEQ ID NO: 559 - DNA, 4841 bp, Artificial sequence
  Synthetic sequence
ggggctctagagaccggtctctcaccatggacatgagggtccccgctcagctcctggggctcctgctgctctggctcccaggtgccaaatgtgatatccaaatgactcaatctccttcttctttgtctgcctcagttggagatagagtaacaataacatgtcaagcctcacaggacatatcaaactatttgaattggtatcaacaaaagcctggtaaagctcctaagttattgatatatgatgcctctaacttagaaactggtgttccatctagattctcaggttctggttctggtacagacttcacattcactatttcatctttgcaaccagaagatatagccacatacttctgccagcacttcgatcatttgcctttagcatttggaggtggtaccaaagtcgaaattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatagctcttaaaaaattccgccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaacgtctaggccccccgaaccacggggacgtggttttcctttgaaaaacacgatgataatatggccacaaccatggagttggggctgtgctgggttttccttgttgctattttagaaggtgtccagtgtcaagtacagttgcaagagtcaggtccaggattagtaaaaccatcagagacattgtcattaacatgtaccgtatctggtggatcagtttcatctggtgactactattggacttggattagacaatctccaggaaagggattagaatggattggtcatatatactattctggaaatactaattacaatccttctttgaagtcaagattgacaatctcaattgatacttcaaagactcagttctcattaaagttgtcatcagttacagctgccgatacagcaatttattattgtgttagggatagggtaaccggtgccttcgatatttggggtcaaggaactatggttaccgtatcttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgggtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtcactctccctgtctccgggtaaataatagaaaactgtcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgaagacagtcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcg

SEQ ID NO: 560 - DNA, 13797 bp, Artificial sequence
  Synthetic sequence
atgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaggtccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggtgtcaaaaggggaggaattgatcaaagagaacatgcatatgaaactgtacatggagggaactgtcaacaatcaccacttcaaatgcacctcagagggcgagggaaagccctacgaagggacccagaccatgcgcattaaggtggtcgaaggcggaccactcccttttgcattcgacatcctggctacctccttcatgtacggatcgcgcacttttatcaagtacccgaaggggatcccggacttcttcaagcaatccttccctgagggattcacttgggaacgggtcacgacctacgaagatggaggcgtggtgaccgtgatgcaagacactagcctggaagatggctgccttgtctacaacgtgaagatcagaggtgtgaacttcccatccaatggccccgtgatgcagaaaaagactctggggtgggaagccaataccgaaatgctctacccagcggacggaggactcgaaggccggtctgacatggccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattagaaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcccatgacgcggctagacatgcacgaccattaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaagctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 561 - DNA, 14523 bp, Artificial sequence
  Synthetic sequence
atgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaggtccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggtgtcaaaaggggaggaattgatcaaagagaacatgcatatgaaactgtacatggagggaactgtcaacaatcaccacttcaaatgcacctcagagggcgagggaaagccctacgaagggacccagaccatgcgcattaaggtggtcgaaggcggaccactcccttttgcattcgacatcctggctacctccttcatgtacggatcgcgcacttttatcaagtacccgaaggggatcccggacttcttcaagcaatccttccctgagggattcacttgggaacgggtcacgacctacgaagatggaggcgtggtgaccgtgatgcaagacactagcctggaagatggctgccttgtctacaacgtgaagatcagaggtgtgaacttcccatccaatggccccgtgatgcagaaaaagactctggggtgggaagccaataccgaaatgctctacccagcggacggaggactcgaaggccggtctgacatggccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattagaaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcccatgacgcggctagacatgcacgaccattaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaagctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 562 - DNA, 14455 bp, Artificial sequence
  Synthetic sequence
atgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaggtccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggtgtcaaaaggggaggaattgatcaaagagaacatgcatatgaaactgtacatggagggaactgtcaacaatcaccacttcaaatgcacctcagagggcgagggaaagccctacgaagggacccagaccatgcgcattaaggtggtcgaaggcggaccactcccttttgcattcgacatcctggctacctccttcatgtacggatcgcgcacttttatcaagtacccgaaggggatcccggacttcttcaagcaatccttccctgagggattcacttgggaacgggtcacgacctacgaagatggaggcgtggtgaccgtgatgcaagacactagcctggaagatggctgccttgtctacaacgtgaagatcagaggtgtgaacttcccatccaatggccccgtgatgcagaaaaagactctggggtgggaagccaataccgaaatgctctacccagcggacggaggactcgaaggccggtctgacatggccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattagaaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcccatgacgcggctagacatgcacgaccattaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaagctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 563 - DNA, 15181 bp, Artificial sequence
  Synthetic sequence
atgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaggtccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggtgtcaaaaggggaggaattgatcaaagagaacatgcatatgaaactgtacatggagggaactgtcaacaatcaccacttcaaatgcacctcagagggcgagggaaagccctacgaagggacccagaccatgcgcattaaggtggtcgaaggcggaccactcccttttgcattcgacatcctggctacctccttcatgtacggatcgcgcacttttatcaagtacccgaaggggatcccggacttcttcaagcaatccttccctgagggattcacttgggaacgggtcacgacctacgaagatggaggcgtggtgaccgtgatgcaagacactagcctggaagatggctgccttgtctacaacgtgaagatcagaggtgtgaacttcccatccaatggccccgtgatgcagaaaaagactctggggtgggaagccaataccgaaatgctctacccagcggacggaggactcgaaggccggtctgacatggccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattagaaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcccatgacgcggctagacatgcacgaccattaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaagctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 564 - DNA, 3760 bp, Artificial sequence
  Synthetic sequence
ccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 565 - DNA, 3901 bp, Artificial sequence
  Synthetic sequence
taaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaa

SEQ ID NO: 566 - DNA, 2494 bp, Artificial sequence
  Synthetic sequence
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 567 - DNA, 2483 bp, Artificial sequence
  Synthetic sequence
atattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 568 - protein, 598 aa, Artificial sequence
  Synthetic sequence
MAPKKKRKVMAKRFYSAEEAAAHCMASSSEQTSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 569 - protein, 246 aa, Artificial sequence
  Synthetic sequence
MKWVTFISLLFLFSSAYSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGKPIPNPLLGLDST

SEQ ID NO: 570 - DNA, 741 bp, Artificial sequence
  Synthetic sequence
atgaagtgggtaacatttattagcctgttgtttctgttttcatcggcttattccgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgcggaaagccgatcccaaaccctctcctcggtctggactccacttaa

SEQ ID NO: 571 - protein, 240 aa, Artificial sequence
  Synthetic sequence
MKWVTFISLLFLFSSAYSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDYKDDDDK

SEQ ID NO: 572 - DNA, 741 bp, Artificial sequence; identical to SEQ ID NO: 570
  Synthetic sequence

SEQ ID NO: 573 - DNA, 2714 bp, Artificial sequence
  Synthetic sequence
atggagacagacacactcctgctatgggtactgctgctctgggttccaggttccactggtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaatagctcttaaaaaattccgccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaacgtctaggccccccgaaccacggggacgtggttttcctttgaaaaacacgatgataatatggccacaaccatggagacagacacactcctgctatgggtactgctgctctgggttccaggttccactggtgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagccccctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggacgaactgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaa

SEQ ID NO: 574 - DNA, 15778 bp, Artificial sequence
  Synthetic sequence
atgggagtgaaggtcctgttcgcactgatttgcatcgccgtggcggaagccgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggaggaaatgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaatgaggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggacatgagggtccccgctcagctcctggggctcctgctgctctggctcccaggtgccaaatgtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaataaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaaccatgacgcggctagacatgcacgaccattaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcgtaggggtcacaattggcagaggggcggcgatcttcaaagtaacctttcttctcctggccgacgatccggggaatgcggatgctggcactgcgattggcgacaccagcagaaaagtcgttgatgttggacgtttcgtggaacccagtcagacgacgggcattgtccaggccccccttgggatcgtaggctcgaatgtggtactggtgccgcttgcttagtttgtcgatggcctcctcgatgcaccgcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgatcccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctgggagctcaccatgtccattatccgtttacacgagtgccttaaatttgtctctgcaggcttccggttgtacttgaaaacttcacagaacaccagcttgttgggatctctgcggaaggggtcccgaaacatggcaacagggtggagatacatgtcactgttggagccctcagactgaaaggtactagagccatcaaaattccactcaggtaactcttctacacacttggggtcacagtccagggtgcgggttttgcagcgcagtccttctccagtaccatcaacccagatatacatcagttggattttctcaccctggggcaggttcatgtacatttgcttgattcctttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 575 - DNA, 15778 bp, Artificial sequence
  Synthetic sequence
atgggagtgaaggtcctgttcgcactgatttgcatcgccgtggcggaagccgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggaggaaatgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaatgaggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggacatgagggtccccgctcagctcctggggctcctgctgctctggctcccaggtgccaaatgtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaataaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaaccatgacgcggctagacatgcacgaccattaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagttcttgtattggaagggttcgtcgcctgtttcgttgaggagacacgtgcggacgatggcttctgtcaccgcataggggtcacaattggcagaaggccgacggtcctcaaagtagcccttcttctcctggccgacagtccggggaatgcggatactggcggagcggttggcaacaccggcagaaaagtcgttgatgttggaggtttcgtggaatccagtcagacgccgggcgttgtccaggccccccttgggatcgtaggcgcggatgtggtactggtgcctcttgctcagtttgtcaatggcctcctcaatgcacttcagaccattctcctcccgcatggccttggtgctgaagttggtatggcagcctgcaccattccagttccctggaatgggcttggggtcaaaggttgctatcaccccaaaatcttcgcacacccgatgcaagataaaacgggctatccaaagatgatctcccattcggattccctcacagggtcctatctggaattcccactgggcaggcataacctccgcatttgtccccgtgatcttgactccagcatacaagcaggcccggtagtgagcctccacgatgtccctgccgtaggccttgtctgctcccacaccgcagtaatacgggccttggggtccagggaagccattggaaggccaaccaaatgggtggccgtctgttcccataagagtatattcctgctccattccaaaccaggggtgctggttgctcaccatgtccattatccgtttacagatgtgcctcaagttggtttctgcaggcttccggttatacttgaaaacttcacatagcaccagcttgttggggtctttgcggaaggggtcccgaaacatggcaacaggatggaggtacatgtcgctgttggagccttcagactgaaaggtactagagccatcaaagttccactcaggtaactcttccacacacttggggtcacagtccagggtacgggtcttgcagcgcagtccttctccggtaccatcaacccagatatacatggcttggattttctcaccctggggcagggacatgtacatttgcttgatgcctttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 576 - DNA, 15778 bp, Artificial sequence
  Synthetic sequence
atgggagtgaaggtcctgttcgcactgatttgcatcgccgtggcggaagccgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggaggaaatgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaatgaggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggacatgagggtccccgctcagctcctggggctcctgctgctctggctcccaggtgccaaatgtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaataaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaaccatgacgcggctagacatgcacgaccattaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtactggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgtggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacaggagtgccttaaatttgtctctgcaggcttccggttgtacttgaaaacttcacagaacaccagcttgttgggctcccggcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaggtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 577 - DNA, 14511 bp, Artificial sequence
  Synthetic sequence
atgggagtgaaggtcctgttcgcactgatttgcatcgccgtggcggaagccgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggaggaaatgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaatgaggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggacatgagggtccccgctcagctcctggggctcctgctgctctggctcccaggtgccaaatgtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaataaaagcttaattaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaaccatgacgcggctagacatgcacgaccattaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgatgtcttcctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 578 - DNA, 15778 bp, Artificial sequence
  Synthetic sequence
atgggagtgaaggtcctgttcgcactgatttgcatcgccgtggcggaagccgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggaggaaatgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaatgaggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggacatgagggtccccgctcagctcctggggctcctgctgctctggctcccaggtgccaaatgtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaataaaagcttaattaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaagggctacaatgaactcgaaacgaccggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaaccatgacgcggctagacatgcacgaccattaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 579 - DNA, 94 bp, Homo sapiens
gctggagcctcggtagccgttcctcctgcccgctgggcctcccaacgggccctcctcccctccttgcaccggcccttcctggtctttgaataaa

SEQ ID NO: 580 - DNA, 173 bp, Simian virus 40
tagtcccgcccctaactccgcccatcccgcccctaactccgcccagttccgcccattctccgccccatcgctgactaattttttttatttatgcagaggccgaggccgcctcggcctctgagctattccagaagtagtgaggaggcttttttggaggcctaggcttttgcaaa

SEQ ID NO: 581 - protein, 711 aa, Simian virus 40
MDKVLNREESLQLMDLLGLERSAWGNIPLMRKAYLKKCKEFHPDKGGDEEKMKKMNTLYKKMEDGVKYAHQPDFGGFWDATEIPTYGTDEWEQWWNAFNEENLFCSEEMPSSDDEATADSQHSTPPKKKRKVEDPKDFPSELLSFLSHAVFSNRTLACFAIYTTKEKAALLYKKIMEKFSVTFISRHNSYNHNILFFLTPHRHRVSAINNYAQKLCTFSFLICKGVNKEYLMYSALTRDPFSVIEESLPGGLKEHDFNPEEAEETKQVSWKLVTEYAMETKCDDVLLLLGMYLEFQYSFEMCLKCIKKEQPSHYKYHEKHYANAAIFADSKNQKTICQQAVDTVLAKKRVDSLQLTREQMLTNRFNDLLDRMDIMFGSTGSADIEEWMAGVAWLHCLLPKMDSVVYDFLKCMVYNIPKKRYWLFKGPIDSGKTTLAAALLELCGGKALNVNLPLDRLNFELGVAIDQFLVVFEDVKGTGGESRDLPSGQGINNLDNLRDYLDGSVKVNLEKKHLNKRTQIFPPGIVTMNEYSVPKTLQARFVKQIDFRPKDYLKHCLERSEFLLEKRIIQSGIALLLMLIWYRPVAEFAQSIQSRIVEWKERLDKEFSLSVYQKMKFNVAMGVGVLDWLRNSDDDDDDSQENADKNEDGGEKNMEDSGHETGIDSQSQGSFQAPQPSQSSQSVHDHNQPYHICRGFTCFKKPSPPPPEPET

SEQ ID NO: 582 - protein, 641 aa, Epstein Barr virus
MSDEGPGTGPGNGLGEKGDTSGPEGSGGSGPQRRGGDNHGRGRGRGRGRGGGRPGAPGGSGSGPRHRDGVRRPQKRPSCIGCKGTHGGTGAGAGAGGAGAGGAGAGGGAGAGGGAGGAGGAGGAGAGGGAGAGGGAGGAGGAGAGGGAGAGGGAGGAGAGGGAGGAGGAGAGGGAGAGGGAGGAGAGGGAGGAGGAGAGGGAGAGGAGGAGGAGAGGAGAGGGAGGAGGAGAGGAGAGGAGAGGAGAGGAGGAGAGGAGGAGAGGAGGAGAGGGAGGAGAGGGAGGAGAGGAGGAGAGGAGGAGAGGAGGAGAGGGAGAGGAGAGGGGRGRGGSGGRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 583 - DNA, 868 bp, Artificial sequence
  Synthetic sequence
aaccctaaacgggtagcatatgcttcccgggtagtagtatatactatccagactaaccctaattcaatagcatatgttacccaacgggaagcatatgctatcgaattagggttagtaaaagggtcctaaggaacagcgatgtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatg

SEQ ID NO: 584 - DNA, 1976 bp, Artificial sequence
  Synthetic sequence
cctttatgtgtaactcttggctgaagctcttacaccaatgctgggggacatgtacctcccaggggcccaggaagattacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgc

What is claimed is:

1. A polynucleotide comprising an open reading frame encoding a glutamine synthetase fused to a heterologous C-terminal extension that reduces the activity of the glutamine synthetase, wherein the glutamine synthetase C-terminal extension comprises the amino acid sequence of SEQ ID NO:502.

2. The polynucleotide of claim 1, wherein the glutamine synthetase comprises the amino acid sequence of any one of SEQ ID NOS:504-508.

3. The polynucleotide of claim 1, wherein the glutamine synthetase is encoded by the nucleic acid sequence of any one of SEQ ID NOS:509-512.

4. The polynucleotide of claim 1, wherein the glutamine synthetase fused to the heterologous C-terminal extension comprises the amino acid sequence of any one of SEQ ID NOS:513-518.

5. The polynucleotide of claim 1, further comprising an intron with the nucleotide sequence of SEQ ID NO:141 in a 3'UTR.

6. The polynucleotide of claim 1, wherein the glutamine synthetase open reading frame is operably linked to a promoter sequence that is 95% identical to the sequence of any one of SEQ ID NOS:83-90.

7. The polynucleotide of claim 1, further comprising a 5'UTR between the promoter and the glutamine synthetase open reading frame.

8. The polynucleotide of claim 7, wherein the 5'UTR comprises the sequence of any one of SEQ ID NOS:500-501.

9. The polynucleotide of claim 1, wherein the polynucleotide comprises the sequence of any one of SEQ ID NOS: 543-556.

10. The polynucleotide of claim 1, wherein the polynucleotide further comprises a pair of transposon ITRs such that the open reading frame encoding the glutamine synthetase can be transposed by a transposase into the genome of a eukaryotic cell.

11. The polynucleotide of claim 1, further comprising a promoter operably linked to a second open reading frame heterologous to the promoter, wherein the promoter comprises the sequence of any one of SEQ ID NOS:29-82.

12. The polynucleotide of claim 1, further comprising an enhancer sequence that is at least 95% identical to the sequence of any one of SEQ ID NOS:11-28.

13. The polynucleotide of claim 1, further comprising an intron sequence that is at least 95% identical to the sequence of any one of SEQ ID NOS:91-141.

14. The polynucleotide of claim 1, further comprising a polyadenylation sequence that is at least 95% identical to the sequence of any one of SEQ ID NOS:192-227.

15. The polynucleotide of claim 1, further comprising the sequence of any one of SEQ ID NOS:-142-191 or SEQ ID NOS:323-365.

16. The polynucleotide of claim 1, further comprising a PRE element comprising the sequence of any one of SEQ ID NOS:242-316.

17. A method for expressing the polynucleotide of claim 1 comprising introducing the polynucleotide into a mammalian cell, wherein the glutamine synthetase is expressed.

18. A mammalian cell comprising the polynucleotide of claim 1.

* * * * *